(12) United States Patent
Feinstein et al.

(10) Patent No.: US 8,614,311 B2
(45) Date of Patent: Dec. 24, 2013

(54) RTP801L SIRNA COMPOUNDS AND METHODS OF USE THEREOF

(71) Applicant: Quark Pharmaceuticals, Inc., Fremont, CA (US)

(72) Inventors: Elena Feinstein, Rehovot (IL); Igor Mett, Rehovot (IL); Hagar Kalinski, Rishon-le-Zion (IL)

(73) Assignee: Quark Pharmaceuticals, Inc., Fremont, CA (US)

( * ) Notice: Subject to any disclaimer, the term of this patent is extended or adjusted under 35 U.S.C. 154(b) by 0 days.

(21) Appl. No.: 13/651,123

(22) Filed: Oct. 12, 2012

(65) Prior Publication Data

US 2013/0131143 A1    May 23, 2013

Related U.S. Application Data

(63) Continuation-in-part of application No. 12/735,061, filed as application No. PCT/IL2008/001606 on Dec. 11, 2008, now abandoned.

(60) Provisional application No. 61/007,480, filed on Dec. 12, 2007.

(51) Int. Cl.
*C07H 21/04* (2006.01)

(52) U.S. Cl.
USPC .......................................................... 536/24.5

(58) Field of Classification Search
USPC .......................................................... 536/24.5
See application file for complete search history.

(56) References Cited

U.S. PATENT DOCUMENTS

| | | | |
|---|---|---|---|
| 5,753,789 A | 5/1998 | Chu et al. |
| 5,874,277 A | 2/1999 | Shintani et al. |
| 5,891,683 A | 4/1999 | Usman et al. |
| 5,898,031 A | 4/1999 | Crooke |
| 5,998,203 A | 12/1999 | Matulic-Adamic et al. |
| 6,107,094 A | 8/2000 | Crooke |
| 6,117,657 A | 9/2000 | Usman et al. |
| 6,235,886 B1 | 5/2001 | Manoharan et al. |
| 6,251,666 B1 | 6/2001 | Beigelman |
| 6,268,490 B1 | 7/2001 | Imanishi et al. |
| 6,372,249 B1 | 4/2002 | Smith et al. |
| 6,455,674 B1 | 9/2002 | Einat et al. |
| 6,506,559 B1 | 1/2003 | Fire et al. |
| 6,555,667 B1 | 4/2003 | Einat et al. |
| 6,586,238 B1 | 7/2003 | Matulic-Adamic et al. |
| 6,602,858 B2 | 8/2003 | Beigelman |
| 6,673,549 B1 | 1/2004 | Furness et al. |
| 6,740,738 B2 | 5/2004 | Einat et al. |
| 7,056,704 B2 | 6/2006 | Tuschl et al. |
| 7,078,196 B2 | 7/2006 | Tuschl et al. |
| 7,335,765 B2 | 2/2008 | Kaneko et al. |
| 7,452,987 B2 | 11/2008 | Giese et al. |
| 7,626,015 B2 | 12/2009 | Feinstein et al. |
| 7,629,456 B2 | 12/2009 | Lange et al. |
| 7,723,052 B2 | 5/2010 | Wechsler et al. |
| 7,741,299 B2 | 6/2010 | Feinstein et al. |
| 7,872,119 B2 | 1/2011 | Feinstein et al. |
| 7,893,245 B2 | 2/2011 | Giese et al. |
| 8,017,764 B2 | 9/2011 | Feinstein et al. |
| 8,067,570 B2 | 11/2011 | Feinstein et al. |
| 8,090,542 B2 | 1/2012 | Khvorova et al. |
| 8,097,710 B2 | 1/2012 | Baulcombe et al. |
| 2002/0119463 A1 | 8/2002 | Faris |
| 2002/0137077 A1 | 9/2002 | Hopkins et al. |
| 2003/0027783 A1 | 2/2003 | Zernicka-Goetz et al. |
| 2003/0104973 A1 | 6/2003 | Einat et al. |
| 2003/0108871 A1 | 6/2003 | Kaser |
| 2003/0108923 A1 | 6/2003 | Tuschl et al. |
| 2003/0165864 A1 | 9/2003 | Lasek et al. |
| 2004/0180351 A1 | 9/2004 | Giese et al. |
| 2004/0192626 A1 | 9/2004 | McSwiggen et al. |
| 2004/0229266 A1 | 11/2004 | Tuschl et al. |
| 2004/0265839 A1 | 12/2004 | Mello et al. |
| 2005/0004064 A1 | 1/2005 | Tei et al. |
| 2005/0020525 A1 | 1/2005 | McSwiggen et al. |
| 2005/0037988 A1 | 2/2005 | Zamore et al. |
| 2005/0080246 A1 | 4/2005 | Allerson et al. |
| 2005/0181382 A1 | 8/2005 | Zamore et al. |
| 2005/0223427 A1 | 10/2005 | Leake et al. |
| 2005/0233342 A1 | 10/2005 | Manoharan et al. |
| 2005/0255487 A1 | 11/2005 | Khvorova et al. |
| 2006/0058266 A1 | 3/2006 | Manoharan et al. |
| 2006/0069056 A1 | 3/2006 | Feinstein et al. |
| 2006/0217329 A1 | 9/2006 | Feinstein |
| 2006/0241072 A1 | 10/2006 | Baker |

(Continued)

FOREIGN PATENT DOCUMENTS

CA    2343602    4/2001
DE    19816395    10/1999

(Continued)

OTHER PUBLICATIONS

Amarzguioui et al., (2003) "Tolerance for Mutations and Chemical Modifications in a siRNA". Nucleic Acids Research, 31(2):589-95.
Barik, (2005) "Silence of the transcripts; RNA Interference in Medicine". Mol. Med, 83:764-773.
Bartel. (2004) "MicroRNAs: Genomics Biogenisis, Mechanism, and Function," Cell, 116:281-97.
Bernstein et al. (2001). "Role for a Bidentate Ribinuclease in the Intiation Step RNA Interference," Nature, 409: 363-66.
Bitko et al. (2004). "Inhibiton of Respiratory Viruses by Nassaly Administered siRNA," Nature Medicine, 11(1) :50-5.
Brafman et al. (2004) "Inhibition of Oxygen-Induced Retinopathy in RTP801-Deficient Mice," Investigative Optjamology & Visual Science, 45(10): 3796-3805.
Bass (2001) "The short answer". Nature 411:428-29.
Braasch et al., (2003) "RNA Interference in Mammalian Cells by Chemically-Modified RNA". Biochemistry, 42:7967-7975.

(Continued)

*Primary Examiner* — Jon E Angell
(74) *Attorney, Agent, or Firm* — John P. White; Cooper & Dunham LLP

(57) ABSTRACT

The invention provides chemically modified siRNA oligonucleotides that target RTP801L, compositions comprising same and to the use of such molecules to treat, inter alia, respiratory diseases including acute and chronic pulmonary disorders, eye diseases including glaucoma and ION, microvascular disorders, angiogenesis- and apoptosis-related conditions, and hearing impairments.

19 Claims, 11 Drawing Sheets

(56) References Cited

U.S. PATENT DOCUMENTS

| | | |
|---|---|---|
| 2007/0031844 A1 | 2/2007 | Khvorova et al. |
| 2007/0032441 A1 | 2/2007 | McSwiggen et al. |
| 2007/0185017 A1 | 8/2007 | Aggarwal et al. |
| 2007/0185047 A1 | 8/2007 | Bhat |
| 2007/0224201 A1 | 9/2007 | Wu et al. |
| 2007/0270579 A1 | 11/2007 | Jadhav et al. |
| 2007/0281326 A1 | 12/2007 | Wechsler et al. |
| 2008/0014599 A1 | 1/2008 | Wechsler et al. |
| 2008/0064650 A1 | 3/2008 | Feinstein et al. |
| 2009/0162365 A1 | 6/2009 | Feinstein et al. |
| 2010/0292301 A1 | 11/2010 | Feinstein et al. |
| 2011/0112168 A1 | 5/2011 | Feinstein et al. |
| 2012/0108647 A1 | 5/2012 | Feinstein et al. |

FOREIGN PATENT DOCUMENTS

| | | |
|---|---|---|
| EP | 0540742 A1 | 5/1993 |
| EP | 1 394 274 A2 | 3/2004 |
| EP | 1009753 B1 | 4/2005 |
| EP | 1 104 808 A1 | 9/2005 |
| EP | 1 580 263 A1 | 9/2005 |
| JP | 2003-259877 | 9/2003 |
| WO | WO 00/14283 | 3/2000 |
| WO | WO 00/44895 | 8/2000 |
| WO | WO 00/44914 | 8/2000 |
| WO | WO 00/61620 | 10/2000 |
| WO | WO 00/77022 A1 | 12/2000 |
| WO | WO 01/36646 A1 | 5/2001 |
| WO | WO 01/68836 | 9/2001 |
| WO | WO 01/70979 A2 | 9/2001 |
| WO | WO 01/75164 | 10/2001 |
| WO | WO 01/77289 A2 | 10/2001 |
| WO | WO 01/12659 A2 | 12/2001 |
| WO | WO 01/96391 | 12/2001 |
| WO | WO 02/31111 A2 | 4/2002 |
| WO | WO 02/44321 A2 | 6/2002 |
| WO | WO 02/46465 A2 | 6/2002 |
| WO | WO 02/055693 | 7/2002 |
| WO | WO 02/068579 A2 | 9/2002 |
| WO | WO 02/101075 A2 | 12/2002 |
| WO | WO 03/010205 A1 | 2/2003 |
| WO | WO 03/025138 | 3/2003 |
| WO | WO 03/029271 A2 | 4/2003 |
| WO | WO 03/064621 | 8/2003 |
| WO | WO 03/070918 | 8/2003 |
| WO | WO 03/074654 | 9/2003 |
| WO | WO 03/087768 A2 | 10/2003 |
| WO | WO 03/101283 | 12/2003 |
| WO | WO 2004/015107 | 2/2004 |
| WO | WO 2004/018999 A2 | 3/2004 |
| WO | WO 2004/031237 | 4/2004 |
| WO | WO 2004/045545 A2 | 6/2004 |
| WO | WO 2004/048368 A2 | 6/2004 |
| WO | WO 2004/060270 A2 | 7/2004 |
| WO | WO 2004/076633 A2 | 9/2004 |
| WO | WO 2004/091383 A2 | 10/2004 |
| WO | WO 2005/016000 A1 | 2/2005 |
| WO | WO 2005/044981 A2 | 5/2005 |
| WO | WO 2005/110464 | 11/2005 |
| WO | WO 2007/087451 | 8/2007 |

OTHER PUBLICATIONS

Brugarolas et al., (2004) "Regulation of Mtor Function in Response to Hypoxia by Reddi and the TSC1/TSC2 Tumor Suppressor Complex," Genes & Development, 18:2893-2904.

Brummelkamp et al. (2002). A System for Stable Expression of Short Interfering RNAs in Mammalian Cells Science, 296-550-553.

Caplen et al., (2001) "Specific Inhibition of Gene Expression by Small Double-Stranded RNAs in Invertebrate Vertebrate Systems". Proc Natl. Acad Sci, 98(17):9742-9747.

Chakraborty (2007) "Potentiality of Small Interfering RNAs- (siRNA)as Recent Therapeutic Targets for Gene-Silencing". Current Drug Targets, 8(3) :469-82.

Chalk et al. (2004). "Improved and Autonated Prediction of Effective siRNA," Biochemical and Biophysical Research Communications, 319: 264-274.

Chiu and Rana, (2002) "RNAi in Human Cells: basic Structural and Function Features of Small Interfering RNA" Molecular Cell, vol. 19, pp. 549-561.

Chiu and Rana, (2003) "siRNA function in RNAi: a chemical modification analysis". RNA, 9 (9) :1034-48.

Corradetti, (2005) The stress-inducted proteins RT801 and RTP801L are negative regulators of the mammalian target of rapamycin pathway. Biol Chem. Mar. 18; 280(11): 9769-72.

Cuaz-Perolin et al., (2004) REDD2 gene is upregulated by modified LDL or hypoxia and mediates human macrophage cell death. Arterioscler Thromb Vasc Biol. Oct.; 24(10) :1830-5. Epub Aug. 12, 2004.

Czauderna et al., (2003) "Structural Variations and Stabilising Modifications of Synthetic siRNAs in Mammalian Cells". NAR 31 (11):2705-16.

Damha et al., (1991) "Oligonucleotides containing unnatural L-2'-deoxyribose". Tetrahedron Letters 32(23) :2573-76.

Damha et al., (1994) "Antisense L/D-Oligodeoxynucleotide Chimeras: Nuclease Stability, Base-Pairing Properties, and Activity at Directing Ribonuclease H". Biochem 33 :7877-7885.

Dudek et al. (2004) TROD: T7 RNAi Oligio Designer, Nucleic Acids Research, 32:W121-W123.

Elbashir et al., (2001) "RNA Interference is Mediated by 21-and 22-nucleotide RNAs" Genes & Development, 15:188-200.

Elbashir et al., (2001) "Functional Anatomy of siRNAs for Mediating Efficient RNAi Drosophila melanogaster Embryo Lysate". EMBO Journal, 20(23) :6877-88.

Elbashir et al., (2001) "Duplexes of 21-nucleotide Mediated RNA Interference in Cultured Mammalian Cells" Nature 411:494-498.

Ellisen (2002) "Redd1, A Developmentally Regulated Transcriptional Target of p63 and p53, Links p63 to Regulation of Reactive Oxygen Species," Molecular Cell, 10: 995-1005.

Ellisen (2005) Growth control under stress: mTOR regulation through REDD1-TSC pathway. Cell Cycle. Nov.; 4(11) : 1500-02.

Elmen et al. (2005) "Locked nucleic acid (LNA) mediated improvements in siRNA stability and functionality." NAR 33 (1) :439-47.

Fire et al., (1998) "Potent and Specific Genetic Interference by Double-Stranded RNA in Caenorhabditis elegans". Nature, vol. 391:806-811.

Frovlov (2003) "Response markers and the Molecular mechanism of Action of Gleevac in Gastrointestinal Stromal Tumors," Molecular Cancer Therapeutics, 2: 699-709.

Honore et al. (2005): Understanding microtubule dynamics for improved cancer therapy. Cell Mol Life Sci. Dec.: 62(24): 3039-56. Review.

Garbesi et al., (1993) "L-DNAs as potential antimessenger oligonucleotides: a reassessment". Nuc. Acids Res. 21(18) :4159-65.

Hohjoh (2004) "Enhancement of RNAi activity by improved siRNA duplexes", FEBS Lett. 557(1-3):193-8.

Holen et al., (2002) "Positional effects of short interfering RNAs targeting the human coagulation trigger Tissue Factor". NAR. 30(8):1757-66.

International Search Report issued Oct. 20, 2010 in respect of International application PCT/IL2007/000695 (WO 2007/141796).

International Preliminary Report on Patentability issued Nov. 9, 2010 by the International Searching Authority (ISA/US) and Written Opinion issued Oct. 20, 2010 in connection with International Application PCT/IL2007/000695 (WO 2007/141796).

International Preliminary Report on Patentability by the International Searching Authority (ISA/US) on Oct. 20, 2009 in connection with International Application PCT/IL08/01606.

International Search Report issued Oct. 20, 2009 in connection with International Application PCT/IL2008/001606 (WO 2009/074990).

International Preliminary Report on Patentability issued Jun. 15, 2010 by the International Searching Authority (ISA/US) and Written Opinion issued on Oct. 20, 2009 in connection with International Application PCT/IL2008/001606 (WO 2009/074990).

International Search Report issued Oct. 7, 2008 in connection with PCT/IL2007/001278 (WO 2008/050329).

(56) References Cited

OTHER PUBLICATIONS

International Preliminary Report on Patentability issued Apr. 28, 2009 including Written Opinion issued Oct. 7, 2008 in connection with PCT/IL2007/001278 (WO2008/050329).
International Search Report issued Dec. 12, 2008 in connection with PCT/IL2008/000248 (WO 2007/091269).
International Preliminary Report on Patentability issued Jan. 19, 2010 including Written Opinion issued Nov. 8, 2008 in connection with PCT/IL2008/000248 (WO 2008/104978).
International Search Report issued Mar. 30, 2009 connection with PCT/IL2008/001197 (WO 2009/044392).
International Preliminary Report on Patentability issued Apr. 7, 2010 including Written Opinion issued Mar. 30, 2009 in connection with PCT/IL2008/001197 (WO 2009/044392).
Jozwiak et al. (2005): Positive and negative regulation of TSC2 activity and its effects on downstream effectors of the mTOR pathway. Neuromolecular Med. 7(4): 287-96.
Kawakami et al., (2005) Thermodynamic analysis of duplex formation of heterochiral DNA with L-deoxyadenosine. Analyt Sci. Feb. 2005 (21):77-82.
Kim et al., (2003) "Identification of Amyloid β-peptide Responsive Genes by cDNA Microarray Technology: Involvement of RTP801 in Amyloid β-peptide Toxicity," Experimental and Molecular Medicine, 35(5): 403-11.
Kurreck (2006) "siRNA efficiency: structure or sequence-that is the question". J Biomed Biotechnol 2006;2006(4):83757.
Lal et al., (2001) "Transcriptional Response to Hypoxia in Human Tumors," Journal of the National Cancer Institute, 93(17): 1337-1343.
Lee et al., (2003), "The nuclear Rnase III Drosha intiates microRNA processing," Nature, 425:415-419.
Lee et al., (2004) Spl-Dependent Regulation of the RTP801 Promoter and Its Application to Hypoxia Inducible VEGF Plasmid for Ischemic Disease, Pharmaceutical Research, 21 (5) 7 736-741.
Levenkova et al., (2004). "Gene specific siRNA selector," Bioinformatics, 20(3) 430-432.
Levkovitch-Verbin (2004) "Animal models of optic nerve diseases". Eye 18:1066-1074.
Liu et al. (2006). Mechanism of Aktl inhibition of breast cancer cell invasion reveals a protumorigenic role for TSC2. Proc Natl Aced Sci USA. Mar. 14; 103(11): 4134-9.
Mahato et al., (2005) "Modulation of Gene Expression by Antisense and Antigene Oligodeoxynucleotides and Small Interfering RNA". Expert Opinion on Drug Delivery 2(11:3-28.
McManus et al., (2002) "Gene Silencing in Mammals by Small Interfering RNAs". Nature Reviews Genetics, 3:737-747.
Morquette, et al. (2011) "mTOR Activity restores Retinal Ganglion Cell Dendritic Arbors and Glutamatergic Inputs After Injury In Vivo". May 3, 2011. Program # 2689/A170. Association for Research in Vision and Ophthalmology (ARVO), Inc., Sunday May 3, 2011.
Pisani et al., (2005) SMHS1 is involved in oxidative/glycolytic-energy metabolism balance of muscle fibers. Biochem Biophys Res Commun Jan. 28;326(4):788-93.
Prakash et al., (2005) "Positional effect of chemical modifications on short interference RNA activity in mammalian cells". J. Med Chem. :48(13)4247-53.
Prakash et al., (2006) "RNA interference by 2',5'-linked nucleic acid duplexes in mammalian cells". Bioorg Med. Cheer: Lett. 16(12):3238-40.
Rangsamy et al., (2004) "Genetic Ablation of Nrf2 Enhances Susceptibility to Cigarette Smoke-Induced Emphysema in Mice," The Journal of Clinical Investigation, 114(9): 1248-59.
Reich et al., (2003) Small interfering RNA (siRNA) targeting VEGF effectively inhibits ocular neovascularization in a mouse model, Molecular Vision, 9:210-216.
Reiling and Hafen (2004) "The Hypoxia-Induced Paralogs Scylla and Charybdis Inhibit Growth by Down-Regulating S6K Activity Upstream of TSC in *Drosophila*," Genes & Development, 18:2879-2892.

Richard et al. (2000) Nonhypoxix Pathway Mediates the Induction of Hypoxia- Inducible Factor 1α in Vascular Smooth Muscle Cells, The Journal of Biological Chemistry, 275(35): 26765-26771.
Sarbassov et al. (2006): Prolonged rapamycin treatment inhibits mTORC2 assembly and Akt/PKB. Mol Cell. Apr. 21;22(2): 159-68.
Schwarzer et al., (2005) "REDD1. Integrates Hypoxia-Mediated Survival Signaling Downstream of Phosphatidulinositol 3-kinase," Oncogene. 24: 1138-1149.
Scherer et al., (2003) "Approaches for the sequence-specific knockdown of mRNA". Nat. Biotechnol. 21(12):1457-1465.
Scherer and Rossi, (2004) "Therapeutic Applications of RNA Interferences: Recent Advances in siRNA Design". Advances in Genetics 22:1-21.
Shoshani et al., (2002) "Identification of a Novel Hypoxia-Induciblle Facto 1-Responsive Gene, RTP801, Involved in Apoptosis," Molecular and Cell Biology, 22(7): 2283-93.
Sioud et al., (2004) "Potential Design Rules and Enzymatic Synthesis of siRNAs" Methods in Molec. Biol., 252:457-468.
Sofer et al. (2005) Regulation of mTor and cell growth in response to energy stress by REDD1. Mol Cell Biol. Jul.; 25(14): 5834-45.
Strausberg et al., (2002) Generation and Initial Analysis of More Than 15,000 Full Length Human Mouse cDNA Sequences, Proceedings of the National Academy of Science of the United States of America, 99(26): 16899-16903.
Tee AR et al/ (2003): Tuberous sclerosis complex gene products, Tuberin and Hamartin, control mTOR signaling by acting as a GTPase-activating protien complex toward Rheb. Curr Biol. Aug. 5; 13(15): 1259-68.
Tolentino et al., (2004). Intravitreal Injection of Vascular Endothelial Growth Factor Small Interfering RNA Inhibits Growth and Leakage in a Nonhuman Primate, Laser-induced Model of Choroidal Neovascularization,: Retina, The Journal of Retinal and Vitreous Diseases, 24(1): 132-8.
Ui-Tei, Kumiko et al., (2004). "Guidelines for the selection of highly effective siRNA sequences for mammalian and chick RNA interference," Nucleic Acids Research, 32 (3) : 936-48.
Ui-Tei et al., (2006) "Essential notes regarding the design of functional siRNAs for efficient mammalian RNAi". J Biomed Biotechnol, 2006:65052.
Ui-Tei et al., (2008) "DNA-modified siRNA-dependent gene silencing with reduced off-target effect is induced through a pathway parallel to that for siRNA-mediated RNA interference." Proc 2008 Micro-NanoMechatronics and Human Science (MHS2008), 339-345.
Ui-Tei et al., (2008) "Functional dissection of siRNA sequence by systematic DNA substitution: modified siRNA with a DNA seed arm is a powerful tool for mammalian gene silencing with significantly reduced off-target effect". Nucleic Acids Res. 36(7):2136-51.
Urata et al., (1992) "Synthesis and properties of mirror-image DNA" Nucleic Acids Research 20(13)3325-3332.
Wang and Ortiz, (2003) "The Binding Sites on Human Heme Oxygenase-1 for Cytochrome P450 Reductase and Biliverdin Reductase," The American Society for Biochemistry and Molecular Biology, Inc., p. 1-38.
Wilson et al., (2009) "Targeted siRNA-Mediated Knockdown of Pro-Apoptotic Genes Delays Adult Retinal Ganglion Cell Death in vivo". Poster 111-A155. Association for Research in Vision and Ophthalmology (ARVO), Inc., Sunday May 3, 2009 Poster Session. p. 111-114.
Zamore et al., (2000) "RNAi: Double-Stranded RNA Directs the ATP-Dependent Cleavage of mRNA at 21 to 23 Nucleotide Intervals". Cell, 101:25-33.
Zhang et al., (2004) "Targeted Gene Silencing by Small Interfering RNA-Based Knock-Down Technology". Curr Pharmac Biotech, 5:1-7.
Non-Final Office Action issued Nov. 19, 2008 in connection with U.S. Appl. No. 11/811,112, filed Jun. 6, 2007.
Non-Final Office Action issued Jul. 25, 2008 in connection with U.S. Appl. No. 11/811,112, filed Jun. 6, 2007.
Notice of Allowance issued Jul. 16, 2009 in connection with U.S. Appl. No. 11/811,112, filed Jun. 6, 2007.
Non-Final Office Action issued Sep. 2, 2010 in connection with U.S. Appl. No. 12/589,972, filed Oct. 29, 2009.

(56) References Cited

OTHER PUBLICATIONS

Final Office Action issued Mar. 15, 2011 in connection with U.S. Appl. No. 12/589,972, filed Oct. 29, 2009.
Notice of Allowance issued May 3, 2011 in connection with U.S. Appl. No. 12/589,972, filed Oct. 29, 2009.
Non-Final Office Action issued Jun. 14, 2012 in connection with U.S. Appl. No. 12/735,061, filed Jan. 13, 2011.
Non-Final Office Action issued Mar. 1, 2012 in connection with U.S. Appl. No. 12/735,061, filed Jan. 13, 2011.
Non-Final Office Action issued Oct. 25, 2012 in connection with U.S. Appl. No. 13/218,053, filed Aug. 25, 2011.
Non-Final Office Action issued May 10, 2012 in connection with U.S. Appl. No. 13/218,053, filed Aug. 25, 2011.
Response filed Oct. 30, 2008 in connection with U.S. Appl. No. 11/811,112.
Response filed Mar. 23, 2009 in connection with U.S. Appl. No. 11/811,112.
Response filed Feb. 1, 2011 in connection with U.S. Appl. No. 12/589,972.
Response filed Jun. 1, 2012 in connection with U.S. Appl. No. 12/735,061.
Response filed Oct. 12, 2012 in connection with U.S. Appl. No. 12/735,061.
Response filed Aug. 27, 2012 in connection with U.S. Appl. No. 13/218,053.

Figure 1

Homo sapiens DNA-damage-inducible transcript 4-like (DDIT4L), mRNA.
ACCESSION   NM_145244
VERSION     NM_145244.2  GI:34222182

```
AGCCGGCGCA GGGUGGCCGG GGAGGGGUGA GCAGGGUGCC GCUGGCUGCU GGGGUCUGCA
GGUCACCGAG UCCCCAGGAG AGGGGACUCC UAAGAAGCCA CCUGCCUGUG UUUACCCGGC
AGCGAGCGCG CAGGCCCCCG CGAACUCCUG GCAGCGCUCA GGAAAGGCCG UUGCGCCUCG
CGAAGGAAAC AGAGCCGUUG ACCAUGGUUG CAACUGGCAG UUUGAGCAGC AAGAACCCGG
CCAGCAUUUC AGAAUUGCUG GACUGUGGCU AUCACCCAGA GAGCCUGCUA AGUGAUUUUG
ACUACUGGGA UUAUGUUGUU CCUGAACCCA ACCUCAACGA GGUAAUAUUU GAGGAAUCAA
CUUGCCAGAA UUUGGUUAAA AUGCUGGAGA ACUGUCUGUC CAAAUCAAAG CAAACUAAAC
UUGGUUGCUC AAAGGUCCUU GUCCCUGAGA ACUGACCCA GAGAAUUGCU CAAGAUGUCC
UGCGGCUUUC CUCAACGGAG CCCUGCGGCU UGCGAGGUUG UGUUAUGCAC GUGAACUUGG
AAAUUGAAAA UGUAUGUAAA AAGCUGGAUA GGAUUGUGUG UGAUUCUAGC GUCGUACCUA
CUUUUGAGCU UACACUUGUG UUUAAGCAGG AGAACUGCUC AUGGACUAGC UUCAGGGACU
UUUUCUUUAG UAGAGGUCGC UUCUCCUCUG GUUUCAGGAG AACUCUGAUC CUCAGCUCAG
GAUUUCGACU UGUUAAGAAA AAACUUUACU CACUGAUUGG AACAACAGUG AUUGAAGGGU
CCUAAAAAGG GAAAAUAUAU AAAGAUUAUU UCAUGAUUGG GUAGUAAAAC UAUUCAGCUA
GUCAGCUAAA GUCAUUUGUA GUUUGCCCCA CCUGCCCUAA AUAAGAAACC CCAAAUGUAG
UCUCUUUUCU UUCUGUGUUU CACAUUCAUA GCAACUGCAG CUAACAGGCU GAUUUUCUGG
CCUUUGGAGA AGUGAUUCAA AAUAGUGUAG AUUUUCUGCA UAGAUCCCAU UUUUGUACAG
AAUUGAAUGG GAUGGAAUAG GUAAGCAAAA GUAGAAGCCC AUUUGAGUUU UACAUUUGAU
UCCACAAUUU GGUUUCAGGU AGGCUUGGUA AUAGACUAUA UAAACCAGAU UUGCCUAUUU
UGAUUUUCAU AUGGCUUUUU UUUCUCUAAG UUUUCAGAGG AUUUUUUAAA UCACAGAAUC
AUACUAAAUG AUAUUUAGCU UAUCAAAACU UCCAAAAGCC CACACCACCA GUUCCUGACU
CAAAUUUGAA GGGUUUUUAG ACAGGAAGGU AGGAUUAAGU AGGUGAGUUU AAUUAAAGCU
UAACCCUAGG UAAGAGUAAA UGAGAAAUAU UACGGCAAUA AUGGAACUGC UUCACUGUUU
CUUGGUGACU UCCUCACUCU AAUGUUUUAA AGAGGCAACA AAAGCUUGUG GUGCCAUUUC
AGUAACCACG GUGUUGUUUU AGAUGCCUUU AUAAGCUCAG UUUCCCCUGU UCUUAAGUGU
UGAAUACUGU CUUUAAACUA GAAAAAUGCA AAAUAUUGAA CUGAUAUUUU UGUGUGUAGU
UGAUUACUCU UCCAUUGAGU GAAUGAUGAA UACCUGUGAG GAUAGGAAAU UAGUUCUGAG
AUCUAGUCCC UCUCUGAUUC ACUUAGUAAU CUAUCCUCUU UUCAGUAUUA CAUGUGCUUA
AUCUCAGAUG AACCAUUUCA CCAUGGCAGU GUUAUCUCAU CUCUGGGCUU UUCUGGGAAU
UGAAGUAUCU CUCCUUAACC CCAAUUGUCA AGGGUAGUAG CUGUAUACUA CCACUUUGAA
UUAUUGAAAC GGGUCAAUUU ACGAAGUCUG CAUUGGCUAU GGAGAUAUGG UUUAUAGUAC
AGCCUAGAGA AUGAAACUCA CCGUCCAGAU AACCAUGCAU GCACCCAGAU UUUUUCCACC
UUGGAUACCU GUCACUAGGG AAUAAUAAAG GCCUUAUUUU UUGUCUUAUU CCAACUAAGU
AGAUCAUUAU CUCUUUCCUU UUUUAUGUUA AUGAGAGAAU UUAGCCUCCA CUCAACAAUG
UUCAAUUCAG CAAGGCUUUC AUAUCCUUGC UGUGGGUCGU GGAUAAGGAG CUUAUUCAGG
UUUCCUGCCC UAGCUAUUAG CUCCACUUCA CAUGCUGGAG ACCGGCUAG GGACAGAUGU
AUUCAUCCUG GUGUUACUGA AAAACAGGUG UGAUCCUGUU ACUGAUACUA UAAGUGACCU
AAAAUGUCAC UGUUCAAAUU AGCCAGUGUU CUAACAAACU AAACUCUUCA AAUGCUUGGA
AAGAUACUAC AAAGCCAAUC UUUAUAGAAU UGGGCCAAGA UAAAUCAAUG UUGUUUUGCA
UGUCUAUUGU UAAGCUCCAA AGGUUCACUG UGUUUCUGCC GCUGUCCUGG AGUUGUCACC
ACUGACUGGG CAAGGCUUCU UGGGCAUCGA UGUAGAACUG UUGUCCUUUU UCCACUAACA
GUUAUCUUUG ACUCUCUUGC CUGUUAUGCU UACAAAAUGG UGAUGGCUUA UGGAAGGCUG
UUAAAUUAAU AUUCCUGUUA AAGGAAAUUA AAGUUUGUCU AUUUUUGACA AUAAAACAUU
AUAUAUUUUU AAAAAAAAAA AAAAAA
```

Figure 2

Table F – Preferred siRNA sequences

| Name | Sense 5' – 3' | AnUisense 5'-3' | Other ID |
|---|---|---|---|
| DDIT4L_6 | CCCAGAGAAUUGCUCAAGA | UCUUGAGCAAUUCUCUGGG | DDIT4L_228; #73 in Table A |
| DDIT4L_12 | CGUGAACUUGGAAAUUGAA | UUCAAUUUCCAAGUUCACG | #4 in Table B |
| DDIT4L_14 | ACGUGAACUUGGAAAUUGA | UCAAUUUCCAAGUUCACGU | #22 in Table B |
| DDIT4L_15 | UGGAGAACUGUCUGUCCAA | UUGGACAGACAGUUCUCCA | #69 in Table B |
| DDIT4L_20 | GUAAAAAGCUGGAUAGGAU | AUCCUAUCCAGCUUUUUAC | #172 in Table A |
| DDIT4L_21 | UGAACUUGGAAAUUGAAAA | UUUUCAAUUUCCAAGUUCA | |
| DDIT4L_22 | GUAUGUAAAAAGCUGGAUA | UAUCCAGCUUUUUACAUAC | #583 in Table A |
| DDIT4L_23 | GAUUUCGACUUGUUAAGAA | UUCUUAACAAGUCGAAAUC | #755 in Table A |
| DDIT4L_24 | GAACUUGGAAAUUGAAAAU | AUUUUCAAUUUCCAAGUUC | |
| DDIT4L_25 | GGAUUUCGACUUGUUAAGA | UCUUAACAAGUCGAAAUCC | #850 in Table A |
| DDIT4L_26 | GCACGUGAACUUGGAAAUU | AAUUUCCAAGUUCACGUGC | #345 in Table A |
| DDIT4L_27 | CCUGAGAAACUGACCCAGA | UCUGGGUCAGUUUCUCAGG | #264 in Table B |
| DDIT4L_28 | GAACUGUCUGUCCAAAUCA | UGAUUUGGACAGACAGUUC | |
| DDIT4L_29 | CUCAGGAUUUCGACUUGUU | AACAAGUCGAAAUCCUGAG | |
| DDIT4L_30 | GCUCAGGAUUUCGACUUGU | ACAAGUCGAAAUCCUGAGC | |
| DDIT4L_31 | GACUUGUUAAGAAAAAACU | AGUUUUUUCUUAACAAGUC | |

Table G    Fig. 3A

| Name | SEQ ID NO: | Sense 5->3 | SEQ ID NO: | AntiSense 5->3 | *1 | *2 | *3 | *4 | *5 |
|---|---|---|---|---|---|---|---|---|---|
| DDIT4L_12_S211 | 6928 | rC;rG;rU;rG;rA;rA;rC;rU;rU;rG;rG;rA;rA;dT;rU;rG;LdC;rA$ | 6966 | mU;rU;mC;rA;mA;rU;mU;rU;mC;rC;mA;rA;mG;rU;mU;rC;mA;rC;mG$ | | | 36 | 62 | |
| DDIT4L_12_S215M1 | 6929 | rC;rG;rU;rG;rA;rA;rC;rU;rU;rG;rG;rA;rA;dT;LdC;rG;LdC;rA$ | 6966 | mU;rU;mC;rA;mA;rU;mU;rU;mC;rC;mA;rA;mG;rU;mU;rC;mA;rC;mG$ | | | 71 | 60 | |
| DDIT4L_12_S219 | 6930 | iB;rC;rG;rU;rG;rA;rA;rC;rU;rU;rG;rG;rA;rA;dT;rU;rG;LdC;rA$ | 6966 | mU;rU;mC;rA;mA;rU;mU;rU;mC;rC;mA;rA;mG;rU;mU;rC;mA;rC;mG$ | | | 66 | 63 | |
| DDIT4L_12_S220M1 | 6931 | LdC;rC;rG;rU;rG;rA;rA;rC;rU;rU;rG;rG;rA;rA;dT;LdC;rG;LdC;rA$ | 6966 | mU;rU;mC;rA;mA;rU;mU;rU;mC;rC;mA;rA;mG;rU;mU;rC;mA;rC;mG$ | | | 55 | 102 | |
| DDIT4L_12_S221 | 6932 | c6Np;rC;rG;rU;rG;rA;rA;rC;rU;rU;rG;rG;rA;rA;dT;rU;rG;LdC;rA$ | 6966 | mU;rU;mC;rA;mA;rU;mU;rU;mC;rC;mA;rA;mG;rU;mU;rC;mA;rC;mG$ | | | 50 | 56 | |
| DDIT4L_12_S222M1 | 6933 | c6Np;rC;rG;rU;rG;rA;rA;rC;rU;rU;rG;rG;rA;rA;dT;LdC;rG;LdC;rA$ | 6966 | mU;rU;mC;rA;mA;rU;mU;rU;mC;rC;mA;rA;mG;rU;mU;rC;mA;rC;mG$ | | | 93 | 104 | |
| DDIT4L_12_S224M1 | 6934 | rC;LdC;rU;rG;rA;rA;rC;rU;rU;rG;rG;rA;rA;dT;rU;rG;LdC;rA$ | 6966 | mU;rU;mC;rA;mA;rU;mU;rU;mC;rC;mA;rA;mG;rU;mU;rC;mA;rC;mG$ | | | 76 | 110 | |
| DDIT4L_12_S225M1 | 6935 | rC;LdC;rU;rG;rA;rA;rC;rU;rU;rG;rG;rA;rA;dT;LdC;rG;LdC;rA$ | 6966 | mU;rU;mC;rA;mA;rU;mU;rU;mC;rC;mA;rA;mG;rU;mU;rC;mA;rC;mG$ | | | 114 | 134 | |
| DDIT4L_12_S389 | 6928 | rC;rG;rU;rG;rA;rA;rC;rU;rU;rG;rG;rA;rA;dT;rU;rG;LdC;rA$ | 6967 | rU;mU;rC;mA;rA;mU;rU;mU;rC;mC;mA;rA;mG;rU;mU;rC;mA;rC;mG$ | | | 72 | 71 | |
| DDIT4L_12_S234M1 | 6929 | rC;rG;rU;rG;rA;rA;rC;rU;rU;rG;rG;rA;rA;dT;LdC;rG;LdC;rA$ | 6967 | rU;mU;rC;mA;rA;mU;rU;mU;rC;mC;mA;rA;mG;rU;mU;rC;mA;rC;mG$ | | | 95 | 89 | |
| DDIT4L_12_S458 | 6930 | iB;rC;rG;rU;rG;rA;rA;rC;rU;rU;rG;rG;rA;rA;dT;rU;rG;LdC;rA$ | 6967 | rU;mU;rC;mA;rA;mU;rU;mU;rC;mC;mA;rA;mG;rU;mU;rC;mA;rC;mG$ | | | 47 | 74 | |
| DDIT4L_12_S381M1 | 6931 | LdC;rC;rG;rU;rG;rA;rA;rC;rU;rU;rG;rG;rA;rA;dT;LdC;rG;LdC;rA$ | 6967 | rU;mU;rC;mA;rA;mU;rU;mU;rC;mC;mA;rA;mG;rU;mU;rC;mA;rC;mG$ | | | 57 | 71 | |
| DDIT4L_12_S382 | 6932 | c6Np;rC;rG;rU;rG;rA;rA;rC;rU;rU;rG;rG;rA;rA;dT;rU;rG;LdC;rA$ | 6967 | rU;mU;rC;mA;rA;mU;rU;mU;rC;mC;mA;rA;mG;rU;mU;rC;mA;rC;mG$ | | | 71 | 49 | |
| DDIT4L_12_S383M1 | 6933 | c6Np;rC;rG;rU;rG;rA;rA;rC;rU;rU;rG;rG;rA;rA;dT;LdC;rG;LdC;rA$ | 6967 | rU;mU;rC;mA;rA;mU;rU;mU;rC;mC;mA;rA;mG;rU;mU;rC;mA;rC;mG$ | | | 46 | 91 | |
| DDIT4L_12_S384M1 | 6934 | rC;LdC;rU;rG;rA;rA;rC;rU;rU;rG;rG;rA;rA;dT;rU;rG;LdC;rA$ | 6967 | rU;mU;rC;mA;rA;mU;rU;mU;rC;mC;mA;rA;mG;rU;mU;rC;mA;rC;mG$ | | | 75 | 86 | |

Fig. 3B

| | | | | | | | |
|---|---|---|---|---|---|---|---|
| DDIT4L_12_S230M1 | 6935 | rC;LdC;rU;rG;rA;rA;rC;rU;rG;rG;rA;rA;dT;LdC;rG;LdC;rA$ | 6967 | rU;mU;rC;mA;rA;mU;rU;mU;rC;rC;mA;rA;mG;rU;mU;rC;mA;rC;mG$ | | 109 | 86 | 3 |
| DDIT4L_20_S211 | 6936 | rG;rA;rA;rA;rA;rA;rA;rG;rC;rU;rG;rA;rU;dA;rG;rG;LdC;rU$ | 6968 | mA;rU;mC;mU;rC;mU;rA;mU;rC;mC;rA;mG;rC;mU;rU;mU;rA;mC$ | 25 | 32 | 28 | 49 |
| DDIT4L_20_S213 | 6937 | rG;rA;rA;rA;rA;rA;rA;rG;rC;rU;rG;rA;rU;dA;rG;LdC;LdC;rU$ | 6968 | mA;rU;mC;rC;mU;rA;mU;rC;mC;rA;mG;rC;mU;rU;mU;rA;mC$ | 28 | 35 | 23 | 31 | — |
| DDIT4L_21_S211 | 6938 | rU;rG;rA;rA;rC;rU;rG;rG;rG;rA;rA;LdC;rA$ | 6969 | mU;rU;mU;rU;mC;rA;mA;rU;mU;rU;rC;mA$ | 22 | 28 | 32 | 40 | — |
| DDIT4L_21_S213 | 6939 | rU;rG;rA;rA;rC;rU;rG;rG;rG;rA;rA;LdC;LdC;rA$ | 6969 | mU;rU;mU;rU;mC;rA;mA;rU;mU;rU;rC;mA$ | 30 | 38 | 55 | 73 |
| DDIT4L_22_S211 | 6940 | rU;rG;rA;rU;rG;rU;rA;rA;rA;rA;LdC;rA$ | 6970 | mU;rU;mU;mC;rA;mG;rC;mU;rU;rC;mA$ | | | | |
| DDIT4L_22_S213 | 6941 | rG;rU;rA;rG;rU;rU;rG;LdC;LdC;LdC;rA$ | 6970 | mU;rU;mU;rA;mU;rA;mC;rA;mG;rC;mU;rU;rC;mA$ | 22 | 21 | 22 | 32 |
| DDIT4L_23_S211 | 6942 | rG;rC;rU;rG;rU;rA;rC;rG;rA;rC;rU;rU$ | 6971 | mU;rU;mC;rG;mA;rA;mC;mA;rU;mC$ | 32 | 51 | 38 | 44 |
| DDIT4L_23_S213 | 6943 | rG;rU;rU;rU;rU;rA;rC;rC;rC;rA;LdC;LdC;LdC;rU$ | 6971 | mU;rU;mC;rC;mA;mA;mC;rA;mU;mC$ | 26 | 23 | 17 | 22 |
| DDIT4L_24_S211 | 6944 | rG;rA;rA;rC;rU;rU;rU;rG;rA;rA;LdC;rA$ | 6972 | mA;rU;mC;mC;rA;mA;rA;mU;rU;rC$ | 40 | 43 | 37 | 34 |
| DDIT4L_24_S213 | 6945 | rG;rA;rA;rC;rU;rU;rU;rG;rG;rA;rA;LdC;rA$ | 6972 | mA;rU;mC;mC;rA;mA;rA;mU;rU;rC$ | 22 | 23 | 19 | 21 |
| DDIT4L_25_S211 | 6946 | rG;rG;rA;rU;rU;rU;rC;rG;rA;rC;LdC;LdC;rU$ | 6973 | mU;rC;mG;rU;mA;rA;mC;rA;mC;rG$ | 29 | 36 | 25 | 28 |
| DDIT4L_25_S213 | 6947 | rU;rG;rG;rU;rU;rC;rA;LdC;LdC;rA$ | 6973 | mU;rC;mG;rU;mA;rA;mC;mA;rC$ | 13 | 21 | 20 | 29 |
| DDIT4L_26_S211 | 6948 | rG;rA;rC;rG;rG;rA;rA;rA;LdC;rU$ | 6974 | mA;rA;mU;rU;mU;rC;mC;rA;mA;rC$ | 33 | 27 | 27 | 26 | — |
| DDIT4L_26_S213 | 6949 | rC;rU;rG;rA;rC;rA;rA;rA;LdC;rA$ | 6974 | mA;rA;mU;rU;mU;rC;mC;rA;mA;rC$ | 49 | 36 | 74 | 72 |
| DDIT4L_27_S211 | 6950 | rC;rC;rU;rG;rA;rA;rA;rA;LdC;rU$ | 6975 | mU;rU;mU;rC;mG;rG;mU;rC;mU;rG$ | 61 | 63 | 78 | 114 |
| DDIT4L_27_S213 | 6951 | rG;rA;rC;rC;rC;rU;rA;LdC;rA$ | 6975 | mU;rU;mU;rC;mU;rG;mA;rG$ | | | | |

Fig. 3C

| | | | | | | |
|---|---|---|---|---|---|---|
| DDIT4L_28_S211 | 6952 | rG;rA;rC;rA;rG;rU;rC;rU;rG;rU;rC;rG;rA;dA;rA;rU;LdC;rA$ | 6976 | mU;rG;mA;rU;mU;rU;mG;rG;mA;rC;mA;rG;mA;rC;rU;mA;rG;mU;rU;mC$ | 40 | 35 | | |
| DDIT4L_28_S213 | 6953 | rG;rA;rC;rU;rG;rU;rC;rG;rU;rG;rU;rC;rC;rA;dA;rA;LdC;LdC;rA$ | 6976 | mU;rG;mA;rU;mU;rG;rG;mA;rC;mA;rG;mU;rU;mC$ | 68 | 73 | | |
| DDIT4L_29_S211 | 6954 | rC;rU;rC;rA;rG;rA;rU;rU;rU;rC;rA;rC;rU;rG;LdC;LdC;rU$ | 6977 | mA;rA;mC;rA;mA;rU;rC;mG;rU;mC;rG;rA;mG$ | 41 | 40 | | |
| DDIT4L_29_S213 | 6955 | rC;rU;rC;rA;rG;rA;rU;rU;rU;rC;rG;rA;rC;dT;rU;LdC;LdC;rU$ | 6977 | mA;rA;mC;rA;mA;rG;mU;rC;mG;rA;mG$ | 38 | 40 | | |
| DDIT4L_30_S211 | 6956 | rG;rC;rU;rC;rA;rG;rA;rU;rU;rU;rC;rA;rU;rG;LdC;LdC;rU$ | 6978 | mA;rC;mA;rA;rG;mA;rG;mA;rC;mU;rU;mG;mA;rA;rG;mU$ | 43 | 31 | | |
| DDIT4L_30_S213 | 6957 | rC;rG;rA;rC;rG;rU;rC;rC;rA;rG;rU;rU;rC;rG;LdC;LdC;rU$ | 6978 | mA;rC;mA;rA;mG;rC;mU;rG;mA;rC;mG;rA;mG;mU$ | 24 | 49 | | |
| DDIT4L_31_S211 | 6958 | rG;rA;rC;rU;rC;rA;rG;rA;rU;rA;rA;rU;rA;LdC;LdC;rU$ | 6979 | mA;rG;mA;rU;mU;mU;rC;mC;rU;mU;mU;rU;mC$ | 41 | 40 | 63 | 67 | 13 | 16 |
| DDIT4L_31_S213 | 6959 | rG;rA;rC;rU;rC;rG;rU;rC;rG;rU;rA;rA;rA;LdC;LdC;rU$ | 6979 | mA;rA;mA;rC;mA;rA;mG;mU;rU;mU;rU;mC$ | 112 | 71 | 122 | 86 | 22 | 24 |
| DDIT4L_14_S211 | 6960 | rA;rC;rU;rG;rU;rA;rG;rU;rA;rC;rU;rG;rU;rG;LdC;LdC;rU;rG$ | 6980 | mU;rC;mA;rA;rU;mU;rU;mC;rG;mC;mU;rU;mU$ | 24 | 38 | 7 | 13 | 8 | 10 |
| DDIT4L_14_S213 | 6961 | rA;rC;rG;rA;rC;rU;rG;rU;rC;rU;rG;rU;rG;LdC;LdC;rA$ | 6980 | mU;rC;mA;rA;rU;mU;rU;mC;rG;mC;rA;mU$ | 51 | 32 | 8 | 22 | | |
| DDIT4L_15_S211 | 6962 | rU;rG;rG;rA;rG;rA;rC;rU;rU;rG;rC;rU;rG;rT;rC;LdC;LdC;rA$ | 6981 | mU;rG;mU;rU;mG;mA;rC;mA;rG;mA;rC;rG;mC$ | 67 | 66 | 59 | 83 | | 10 |
| DDIT4L_15_S213 | 6963 | rU;rG;rG;rA;rG;rA;rA;rC;rU;rC;rG;rU;dT;rC;LdC;LdC;rU$ | 6981 | mU;rU;mG;mU;rG;mA;rC;mA;rG;mA;rC;mA$ | 28 | 29 | 18 | 28 | | 10 |
| DDIT4L_6_S211 | 6964 | rC;rG;rC;rU;rC;rA;rG;rA;rA;rG;rA;rA;rG;LdC;LdC;rA$ | 6982 | mA;rU;rC;mA;rC;mU;rU;mG;rA;mG;rA;mG;rA;mU$ | 22 | 26 | | | | 3 |
| DDIT4L_6_S213 | 6965 | rC;rG;rC;rU;rC;rA;rG;rA;rA;rG;rA;rA;rG;LdC;LdC;rA$ | 6982 | mU;rG;mU;rU;mC;mU;rU;mC;mU;rU;mC;rU;mG;rG$ | 49 | 41 | | | | — |

Activity of REDD2 siRNAs on the endogenous REDD2 gene in wt MEF cells following H2O2 treatment Results are presented as residual REDD2 expression.

Dose dependent activity of REDD2 siRNA oligos as measured in 801 wt MEF cells. Results are presented as residual REDD2 expression.

Activity of REDD2 siRNAs on the endogenous REDD2 gene in wt 293T Results are presented as residual REDD2 expression.

Dose dependent activity of RTP801L siRNA as measured in 293T cells. Results are presented as residual RTP801L expression.

Figure 8A

| siRNA duplex name | SEQ ID NO: | N-DNA; N-2'Ome<br>n- L-DNA | Activity at 20nM-% of control |
|---|---|---|---|
| DDIT4L_20_S1-DS | 131726 | 6936 GUAAAAAGCUGGAU*A*GG*c*U<br>6968 AU<u>CC</u>U<u>A</u>U<u>CC</u>A<u>G</u>CUU<u>U</u>U<u>U</u>A<u>C</u> | 25-hum<br>28-rat |
| DDIT4L_20_S2-DS | 131727 | 6937 GUAAAAAGCUGGAU*A*G*cc*U<br>6968 AU<u>CC</u>U<u>A</u>U<u>CC</u>A<u>G</u>CUU<u>U</u>U<u>U</u>A<u>C</u> | 28-hum<br>23-rat |
| DDIT4L_21_S1-DS | 131728 | 6938 UGAACUUGGAAAUU*GA*A*c*A<br>6969 UU<u>U</u>U<u>C</u>A<u>A</u>U<u>U</u>U<u>CC</u>A<u>A</u>G<u>UU</u>C<u>A</u> | 22-hum<br>32-rat |
| DDIT4L_21_S2-DS | 131729 | 6939 UGAACUUGGAAAUU*GA*A*c*A<br>6969 UU<u>U</u>U<u>C</u>A<u>A</u>U<u>U</u>U<u>CC</u>A<u>A</u>G<u>UU</u>C<u>A</u> | 30-hum<br>55-rat |
| DDIT4L_23_S1-DS | 131732 | 6942 GAUUUCGACUUGUU*AA*G*c*A<br>6971 UU<u>C</u>U<u>U</u>A<u>A</u>C<u>AA</u>G<u>U</u>C<u>G</u>A<u>AA</u>U<u>C</u> | 22-hum<br>22-rat |
| DDIT4L_23_S2-DS | 131733 | 6943 GAUUUCGACUUGUU*AA*cc*A<br>6971 UU<u>C</u>U<u>U</u>A<u>A</u>C<u>AA</u>G<u>U</u>C<u>G</u>A<u>AA</u>U<u>C</u> | 32-hum<br>38-rat |
| DDIT4L_24_S1-DS | 131734 | 6944 GAACUUGGAAAUUG*A*A*c*U<br>6972 AU<u>U</u>U<u>U</u>C<u>A</u>A<u>U</u>U<u>U</u>C<u>C</u>A<u>A</u>G<u>UU</u>C | 26-hum<br>17-rat |
| DIT4L_24_S2-DS | 131735 | 6945 GAACUUGGAAAUUG*A*A*cc*U<br>6972 AU<u>U</u>U<u>U</u>C<u>A</u>A<u>U</u>U<u>U</u>C<u>C</u>A<u>A</u>G<u>UU</u>C | 40-hum<br>37-rat |
| DDIT4L_25_S1-DS | 131736 | 6946 GGAUUUCGACUUGU*TA*A*c*A<br>6973 U<u>C</u>U<u>U</u>A<u>A</u>C<u>AA</u>G<u>U</u>C<u>G</u>A<u>AA</u>U<u>CC</u> | 22-hum<br>19-rat |
| DDIT4L_25_S2-DS | 131737 | 6947 GGAUUUCGACUUGU*TA*cc*A<br>6973 U<u>C</u>U<u>U</u>A<u>A</u>C<u>AA</u>G<u>U</u>C<u>G</u>A<u>AA</u>U<u>CC</u> | 29-hum<br>25-rat |
| DDIT4L_26_S1-DS | 131738 | 6948 GCACGUGAACUUGG*AA*A*c*U<br>6974 A<u>A</u>U<u>U</u>U<u>CC</u>A<u>A</u>G<u>UU</u>C<u>A</u>C<u>G</u>U<u>G</u>C | 13-hum<br>20-rat |
| DDIT4L_26_S2-DS | 131739 | 6949 GCACGUGAACUUGG*AA*cc*U<br>6974 A<u>A</u>U<u>U</u>U<u>CC</u>A<u>A</u>G<u>UU</u>C<u>A</u>C<u>G</u>U<u>G</u>C | 33-hum<br>27-rat |

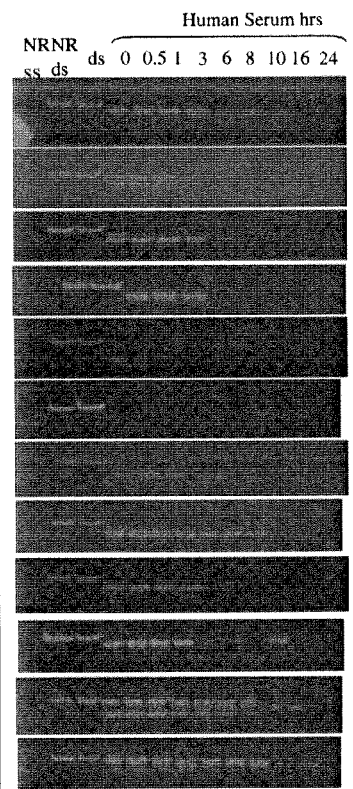

Figure 8B

| siRNA duplex name | ID | SEQ ID NO: | N-DNA; N=2'-5'-nucs; N-LNA; N-2'Ome<br>n- L-DNA; C6-Im-Pi -C6-IminoPi | Activity at 20nM-% of target gene |
|---|---|---|---|---|
| DDIT4L_14_S1 | 128339 | 6960<br>6980 | ACGUGAACUUGGAAA*U*U*c*A<br>U<u>C</u>A<u>A</u>U<u>UU</u>C<u>C</u>A<u>A</u>G<u>UU</u>C<u>A</u>C<u>G</u>U | 24-hum<br>7-rat |
| DDIT4L_14_S2 | 128340 | 6961<br>6980 | ACGUGAACUUGGAAA*U*cc*A<br>U<u>C</u>A<u>A</u>U<u>UU</u>C<u>C</u>A<u>A</u>G<u>UU</u>C<u>A</u>C<u>G</u>U | 32-hum<br>8-rat |
| DDIT4L_15_S1 | 128341 | 6962<br>6981 | UGGAGAACUGUCUG*U*CC*c*A<br>U<u>U</u>G<u>G</u>A<u>C</u>A<u>G</u>A<u>C</u>A<u>G</u>U<u>U</u>C<u>U</u>C<u>C</u>A | 28-hum |
| DDIT4L_15_S2 | 128343 | 6963<br>6981 | UGGAGAACUGUCUGUC*cc*A<br>U<u>U</u>G<u>G</u>A<u>C</u>A<u>G</u>A<u>C</u>A<u>G</u>U<u>U</u>C<u>U</u>C<u>C</u>A | 67<br>59-rat |
| DDIT4L_6_S1 | 128344 | 6964<br>6982 | CCCAGAGAAUUGCUCA*A*c*A<br>U<u>C</u>U<u>U</u>G<u>A</u>G<u>C</u>A<u>A</u>U<u>U</u>C<u>U</u>C<u>U</u>G<u>G</u>G | 22-hum |
| DDIT4L_6_S2 | 128345 | 6965<br>6982 | CCCAGAGAAUUGCUCA*cc*A<br>U<u>C</u>U<u>U</u>G<u>A</u>G<u>C</u>A<u>A</u>U<u>U</u>C<u>U</u>C<u>U</u>G<u>G</u>G | 49-hum |

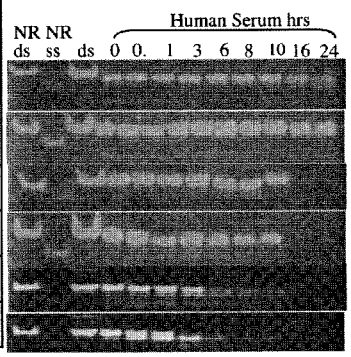

RTP801L SIRNA COMPOUNDS AND METHODS OF USE THEREOF

This application is a continuation-in-part of U.S. Ser. No. 12/735,061, filed Jan. 13, 2011, which is a §371 national stage of PCT International Application No. PCT/IL2008/001606, filed Dec. 11, 2008, claiming the benefit of U.S. Provisional Application No. 61/007,480, filed Dec. 12, 2007, the content of all of which are hereby incorporated by reference into the subject application.

This application incorporates-by-reference nucleotide and/or amino acid sequences which are present in the file named "121012_2094_76494-B-PCT-US_Sequence_Listing_SZ.txt," which is 1.27 megabytes in size, was created on Sep. 13, 2012, in the IBM-PCT machine format, having an operating system compatibility with MS-Windows and is contained in the text file submitted Oct. 12, 2012 as part of the above-identified application.

FIELD OF THE INVENTION

The present invention relates to double stranded oligonucleotide inhibitors of RTP801L (RTP801-like; REDD2, DNA-damage-inducible transcript 4-like, DDIT4_L), pharmaceutical compositions comprising same and methods of use thereof. The compounds and compositions are thus useful in the treatment of subjects suffering from diseases or conditions and or symptoms associated with such diseases or conditions in which RTP801L expression has adverse consequences. In particular embodiments, the invention provides chemically modified siRNA oligonucleotides, compositions comprising same and to the use of such molecules to treat, inter alia, respiratory disorders of all types (including acute and chronic pulmonary disorders), eye diseases including glaucoma and ION, microvascular disorders, angiogenesis- and apoptosis-related conditions, and hearing impairments.

BACKGROUND OF THE INVENTION siRNAs and RNA Interference

RNA interference (RNAi) is a phenomenon involving double-stranded (ds) RNA-dependent gene specific posttranscriptional silencing. Originally, attempts to study this phenomenon and to manipulate mammalian cells experimentally were frustrated by an active, non-specific antiviral defense mechanism which was activated in response to long dsRNA molecules (see Gil et al. 2000, *Apoptosis*, 5:107-114). Later it was discovered that synthetic duplexes of 21 nucleotide RNAs could mediate gene specific RNAi in mammalian cells, without the stimulation of the generic antiviral defense mechanisms (see Elbashir et al., 2001. *Nature*, 411:494-498 and Caplen et al., 2001. *PNAS*, 98:9742-9747). As a result, small interfering RNAs (siRNAs), which are short double-stranded RNAs, have become powerful tools in attempting to understand gene function. Thus RNA interference (RNAi) refers to the process of sequence-specific post-transcriptional gene silencing in mammals mediated by small interfering RNAs (siRNAs) (Fire et al, 1998, *Nature* 391:806) or microRNAs (miRNAs) (Ambros, 2004. *Nature* 431:7006, 350-355; and Bartel, 2004. *Cell*. 116(2):281-97). The corresponding process in plants is commonly referred to as specific post transcriptional gene silencing or RNA silencing and is also referred to as quelling in fungi.

An siRNA is a double-stranded RNA molecule which down-regulates or silences (prevents) the expression of a gene/mRNA of its endogenous or cellular counterpart. The mechanism of RNA interference is detailed infra.

siRNA has been successfully used for inhibition in primates; (for further details see Tolentino et al., 2004. *Retina* 24(1):132-138). Several studies have revealed that siRNA therapeutic agents are effective in vivo in both mammals and in humans. Bitko et al., have shown that specific siRNA molecules directed against the respiratory syncytial virus (RSV) nucleocapsid N gene are effective in treating mice when administered intranasally (Bitko et al., 2005. *Nat. Med.* 11(1):50-55). Reviews of the use of siRNA as a therapeutic agent recently published (see for example Barik 2005. *J. Mol. Med.* 83:764-773 and Dykxhoorn et al., 2006. *Gene Therapy* 13:541-552). In addition, clinical studies with short siRNAs that target the VEGFR1 receptor for the treatment of Age-Related Macular Degeneration (AMD) have been conducted in human patients. (Kaiser, 2006. *Am. J Ophthalmol.* 142(4): 660-8).

Chemically Modified siRNA

The selection and synthesis of siRNA corresponding to known genes has been widely reported; (see for example Ui-Tei et al., 2006. *J Biomed Biotechnol.*; 2006:65052; Chalk et al., 2004. *BBRC*. 319(1): 264-74; Sioud & Leirdal, 2004. *Met. Mol Biol.*; 252:457-69; Levenkova et al., 2004, *Bioinform.* 20(3):430-2; Ui-Tei et al., 2004. *NAR* 32(3):936-48).

For examples of the use of, and production of, modified siRNA see for example Braasch et al., 2003. *Biochem.*, 42(26):7967-75; Chiu et al., 2003, *RNA*, 9(9):1034-48; PCT publications WO 2004/015107 (atugen AG) and WO 02/44321 (Tuschl et al). U.S. Pat. Nos. 5,898,031 and 6,107, 094 teach chemically modified oligomers. US patent publication 2005/0080246 relates to oligomeric compounds having an alternating motif. US patent publication 2005/0042647 describes dsRNA compounds having chemically modified internucleoside linkages.

The inclusion of a 5'-phosphate moiety was shown to enhance activity of siRNAs in *Drosophila* embryos (Boutla, et al., 2001, *Curr. Biol.* 11:1776-1780) and is required for siRNA function in human HeLa cells (Schwarz et al., 2002, *Mol. Cell*, 10:537-548).

Amarzguoui et al., (2003, *NAR*, 31(2):589-595) showed that siRNA activity depended on the positioning of the 2'-O-methyl modifications. Holen et al (2003, *NAR*, 31(9):2401-2407) report that an siRNA having small numbers of 2'-O-methyl modified nucleosides gave good activity compared to wild type but that the activity decreased as the numbers of 2'-O-methyl modified nucleosides was increased. Chiu and Rana (2003, *RNA*, 9:1034-1048) teach that incorporation of 2'-O-methyl modified nucleosides in the sense or antisense strand (fully modified strands) severely reduced siRNA activity relative to unmodified siRNA. The placement of a 2'-O-methyl group at the 5'-terminus on the antisense strand was reported to severely limit activity whereas placement at the 3'-terminus of the antisense and at both termini of the sense strand was tolerated (Czauderna et al., 2003, *NAR*, 31(11), 2705-2716).

PCT Patent Publication Nos. PCT/IL2008/000248 and PCT/IL2008/001197 assigned to the assignee of the present invention disclose motifs useful in the preparation of chemically modified siRNA compounds.

RTP801L

Gene RTP801 (REDD1, DDIT4), was first reported by the assignee of the instant application. U.S. Pat. Nos. 6,455,674, 6,555,667, and 6,740,738, all assigned to the assignee of the instant application, disclose and claim per se the RTP801 polynucleotide and polypeptide, and antibodies directed toward the polypeptide. RTP801 represents a unique gene target for hypoxia-inducible factor-1 (HIF-1) that may regulate hypoxia-induced pathogenesis independent of growth factors such as VEGF. Further discoveries relating to gene RTP801, as discovered by the assignee of the instant application, were reported in Shoshani, et al. 2002. *Mol. Cell. Biol.*, 22(7):2283-2293; this paper, co-authored by the inventor of the present invention, details the discovery of the RTP801 gene. Gene RTP801L, so named because of its resemblance to RTP801, was also first reported by the assignee of the instant application, and given Pubmed accession No. NM_145244 subsequent to said report.

While RTP801 and RTP801L share sequence homology of about 65% at the amino acid level, indicating a possible similarity of function, and while the assignee of the present invention has found that both RTP801 and RTP801L interact with TSC2 and affect the mTOR pathway, the inventors of the present invention have found that the embryological expression pattern of the two polypeptides differs, and that, contrary to RTP801, RTP801L is not induced by hypoxia in all conditions which induce RTP801 expression; it is, however, induced in MEFs as a result of $H_2O_2$ treatment (hypoxia treatment), and the induction follows kinetics similar to those of RTP801 expression induction under the same conditions. Additionally, the inventors of the present invention have found that RTP801 polypeptide is more abundantly expressed than RTP801L. Thus, RTP801L may serve as a target in the treatment of conditions for which RTP801 is a target, and may have the added benefit of a similar, yet different, target.

The following patent applications and publications give aspects of background information relating to RTP801L: Patent application/publication Nos. EP1580263, WO2003029271, WO2001096391, WO2003087768, WO2004048938, WO2005044981, WO2003025138, WO2002068579, EP1104808 and CA2343602 all disclose a nucleic acid or polypeptide which is homologous to RTP801L. Various groups have studied the mechanism of action of RTP801L (Corradetti et al., 2005. *J Biol. Chem.* 280(11):9769-72; Pisani et al., 2005. *BBRC* 326(4):788-93; Cuaz-perolin et al., 2004 *Arterioscler Thromb Vasc Biol.* 24(10):1830-5; Sofer et al., 2005 *Mol Cell Biol.* 25(14):5834-45).

Inhibitors of RTP801L are disclosed in PCT patent publication WO 2007/141796, assigned to the assignee of the present invention and incorporated herein by reference in its entirety. Use of those inhibitors in treating numerous indications is disclosed therein.

SUMMARY OF THE INVENTION

The present invention relates in part to chemically modified RTP801L siRNA, and in particular to chemically modified RTP801L siRNA oligonucleotides having sense and antisense sequences set forth in Tables A-F. The chemically modified siRNA compounds disclosed herein are useful in down regulating RTP801L expression. The compounds according to the present invention exhibit properties that render them useful as therapeutic agents for treatment of a subject suffering from a disease or disorder associated with RTP801L expression. Specifically the compounds exhibit high activity, and/or serum stability and/or reduced off-target effects and/or reduced adverse immune response as compared to an unmodified siRNA compound. The present invention additionally provides novel RTP801L siRNA oligonucleotide pairs shown in Tables B-F and set forth in SEQ ID NOS:1852-6927. PCT patent publication WO 2007/141796, incorporated by reference herein, discloses the oligonucleotide pairs shown in Table A set forth in SEQ ID NO: 2-1851.

The present invention provides pharmaceutical compositions comprising one or more such oligonucleotides. The present invention further relates to methods for treating or preventing the incidence or severity of various diseases or conditions in a subject in need thereof wherein the disease or condition and/or symptoms associated therewith is selected from the group consisting of an ophthalmic disease or condition, a respiratory disease, an ischemic disease, a microvascular disease, an angiogenesis- and an apoptosis-related condition, a hearing impairment or any other disease, condition or combination of conditions as disclosed herein. Such methods involve administering to a mammal in need of such treatment a prophylactically or therapeutically effective amount of one or more such chemically modified siRNA compound, which inhibits or reduces expression or activity of RTP801L.

In one aspect the present invention provides a compound having the following structure:

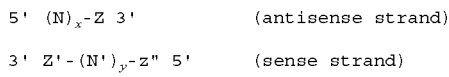

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present; wherein z" may be present or absent, but if present is a capping moiety covalently attached at the 5' terminus of (N') y;
each of x and y is independently an integer between 18 and 40;
wherein the sequence of (N)x is substantially complementary to the sequence of (N')y; and the sequence of (N')y is substantially identical to any one of the sense sequences set forth in any one of Tables B-F.

In certain preferred embodiments the present invention provides an siRNA compound comprising an antisense strand (N)x and its substantially complementary sense strand (N')y, set forth in any one of SEQ ID NOS:1852-6927. The siRNA compounds consist of unmodified ribonucleotides or a combination of unmodified ribonucleotides and ribonucleotides and or unconventional moieties.

In some embodiments the chemically modified siRNA compounds according to the present invention comprise the oligonucleotides disclosed in Tables B-F.

In some embodiments, the present invention provides a chemically modified siRNA compound having the following structure:

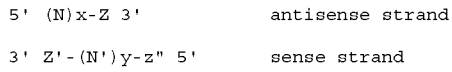

wherein each of N and N' is a nucleotide selected from an unmodified ribonucleotide and a modified ribonucleotide;
wherein each of (N)x and (N')y is an oligomer in which each consecutive ribonucleotide is joined to the next ribonucleotide by a covalent bond;
wherein each of x and y is independently an integer between 18 and 40;
wherein in each of (N)x and (N')y the ribonucleotides alternate between modified ribonucleotides and unmodified ribonucleotides each modified ribonucleotide being modified so as to have a 2'-O-methyl on its sugar and the ribonucleotide located at the middle position of (N)x being unmodified and the ribonucleotide located at the middle position of (N')y being modified;
wherein each of Z and Z' may be present or absent, but if present is 1-5 deoxyribonucleotides covalently attached at the 3' terminus of the oligomer to which it is attached;
wherein the sequence of (N)x is substantially complementary to the sequence of (N')y; and wherein the sequence of (N')y is substantially identical to any one of the sense sequences set forth in any one of Tables B-F.

The present invention provides additional chemically modified RTP801L siRNA compounds. In some embodiments, the present invention provides a compound having the following structure:

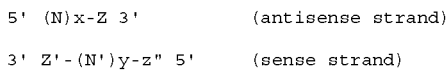

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent, but if present is a capping moiety covalently attached at the 5' terminus of (N')y;
wherein each of x and y is independently an integer between 18 and 40;
wherein (N)x comprises modified and unmodified ribonucleotides, each modified ribonucleotide having a 2'-O-methyl on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;
wherein in (N')y at least one unconventional moiety is present, which unconventional moiety may be a modified or unmodified deoxyribonucleotide, a mirror nucleotide, or a nucleotide joined to an adjacent nucleotide by a 2'-5' internucleotide phosphate bond;
wherein the sequence of (N)x is substantially complementary to the sequence of (N')y; and the sequence of (N')y is substantially identical to a sequence of identical length of consecutive ribonucleotides in the mRNA set forth in SEQ ID NO:1.

In various embodiments the compound of the invention comprises an antisense sequence (N)x present in any one of Tables A-F, set forth in SEQ ID NOS:2-6927. In certain embodiments (N)x comprising the oligonucleotide set forth in SEQ ID NO:999 or SEQ ID NO:1000. In other embodiments (N)x comprising the oligonucleotide set forth in SEQ ID NO:6914 or SEQ ID NO:6915.

In some embodiments the covalent bond joining each consecutive N or N' is a phosphodiester bond. In various embodiments all the covalent bonds are phosphodiester bonds.

In various embodiments x=y and each of x and y is 19, 20, 21, 22 or 23. In some embodiments x=y=23. In other embodiments x=y=19.

In one embodiment of the above structure, the compound comprises at least one mirror nucleotide at one or both termini in (N')y. In various embodiments the compound comprises two consecutive mirror nucleotides, one at the 3' penultimate position and one at the 3' terminus in (N')y. In one preferred embodiment x=y=19 and (N')y comprises an L-deoxyribonucleotide at position 18.

In some embodiments the mirror nucleotide is selected from an L-ribonucleotide and an L-deoxyribonucleotide. In various embodiments the mirror nucleotide is an L-deoxyribonucleotide. In some embodiments y=19 and (N')y, consists of unmodified ribonucleotides at positions 1-17 and 19 and one L-DNA at the 3' penultimate position (position 18). In other embodiments y=19 and (N')y consists of unmodified ribonucleotides at position 1-16 and 19 and two consecutive L-DNA at the 3' penultimate position (positions 17 and 18).

In another embodiment of the above structure, (N')y further comprises one or more nucleotides containing an intra-sugar bridge at one or both termini.

In another embodiment of the above structure, (N')y comprises at least two consecutive nucleotide joined together to the next nucleotide by a 2'-5' phosphodiester bond at one or both termini. In certain preferred embodiments in (N')y the 3' penultimate nucleotide is linked to the 3' terminal nucleotide with a 2'-5' phosphodiester bridge.

In certain preferred embodiments the compound of the invention is a blunt-ended (z", Z and Z' are absent), double stranded oligonucleotide structure, x=y and x=19 or 23, wherein (N')y comprises unmodified ribonucleotides in which three consecutive nucleotides at the 3' terminus are joined together by two 2'-5' phosphodiester bonds; and an antisense strand (AS) of alternating unmodified and 2'-O methyl sugar-modified ribonucleotides.

In additional embodiments (N)x comprises modified ribonucleotides in alternating positions wherein each N at the 5' and 3' termini are modified in their sugar residues and the middle ribonucleotide is not modified, e.g. ribonucleotide in position 10 in a 19-mer strand or position 12 in a 23-mer strand.

In some embodiments, neither (N)x nor (N')y are phosphorylated at the 3' and 5' termini. In other embodiments either or both (N)x and (N')y are phosphorylated at the 3' termini.

In various embodiments the compound comprises an antisense and sense oligonucleotide pair present in any one of Tables A-G set forth in SEQ ID NOS:2-6927.

In certain embodiments for all the above-mentioned structures, the compound is blunt ended, for example wherein both Z and Z' are absent. In an alternative embodiment, the compound comprises at least one 3' overhang, wherein at least one of Z or Z' is present. Z and Z' can independently comprise one or more covalently linked modified or non-modified nucleotides, for example inverted dT or dA; dT, LNA, mirror nucleotide and the like. In some embodiments each of Z and Z' are independently selected from dT and dTdT.

In some embodiments the present invention provides an expression vector comprising an antisense sequence present in any one of Tables B-F.

In a second aspect the present invention provides a pharmaceutical composition comprising one or more compounds of the present invention, in an amount effective to inhibit RTP801L human gene expression and a pharmaceutically acceptable carrier.

In another aspect, the present invention relates to a method for the treatment of a subject in need of treatment for a disease or disorder or symptoms or conditions associated with the disease or disorder, associated with the expression of RTP801L comprising administering to the subject an amount of an siRNA which reduces or inhibits expression of RTP801L.

More specifically, the present invention provides methods, compounds and compositions useful in therapy for treating a subject suffering from acute renal failure (ARF), hearing loss, glaucoma, acute respiratory distress syndrome (ARDS) and other acute lung and respiratory injuries, injury (e.g. ischemia-reperfusion injury) in organ transplant including lung, kidney, bone marrow, heart, pancreas, cornea or liver transplantation, nephrotoxicity, spinal cord injury, pressure sores, dry eye syndrome, oral mucositis and chronic obstructive pulmonary disease (COPD). The methods of the invention comprise administering to the subject one or more siRNA compounds which inhibit expression of RTP801L in a therapeutically effective dose so as to thereby treat the patient.

According to one embodiment the compound consists of an antisense strand having an oligomer sequence set forth in SEQ ID NO:1000 and a sense strand having an oligomer sequence set forth in SEQ ID NO:75. According to one embodiment the compound consists of an antisense strand having an oligomer sequence set forth in SEQ ID NO:999 and a sense strand having an oligomer sequence set forth in SEQ ID NO:74. According to another embodiment, the compound consists of an antisense strand having an oligomer sequence set forth in SEQ ID NO:6914 and a sense strand having an oligomer sequence set forth in SEQ ID NO:6898 (DDIT4L_14 in Table F). According to another embodiment, the compound consists of an antisense strand having an oligomer sequence set forth in SEQ ID NO:6915 and a sense strand having an oligomer sequence set forth in SEQ ID NO:6899 (DDIT4L_15 in Table F).

In various embodiments the siRNA compound is selected from any one of the compounds shown in Table G (FIG. 3).

In certain preferred embodiments the siRNA compounds indicated above are modified so at to have antisense strand comprising alternating 2'OMe and unmodified ribonucleotides, and a sense strand comprising unmodified ribonucleotides and an L-DNA moiety at position 18 or at positions 17 and 18. In some embodiments the sense strand further includes a deoxyribonucleotide at position 15.

In another aspect the present invention provides a pharmaceutical composition comprising on or more RTP801L siRNA inhibitors of the invention; and a pharmaceutically acceptable excipient.

In another aspect, the present invention provides a method of treating a patient suffering from a microvascular disorder, macular degeneration or a respiratory disorder, comprising administering to the patient a pharmaceutical composition comprising one or more RTP801L inhibitor.

Another embodiment of the present invention concerns a method for treating a patient suffering from COPD, comprising administering to the patient a pharmaceutical composition comprising a therapeutically effective amount of one or more siRNA RTP801L inhibitor. In one embodiment the inhibitor is selected from the group consisting of an siRNA molecule, an antisense molecule, and a ribozyme or a combination thereof.

Another embodiment of the present invention concerns a method for treating a patient suffering from Acute Lung Injury (ALI), comprising administering to the patient a pharmaceutical composition comprising a therapeutically effective amount of one or more RTP801L inhibitor. In one embodiment the inhibitor selected from the group consisting of an siRNA molecule, an antisense molecule, and a ribozyme or a combination thereof.

Another embodiment of the present invention concerns a method for treating a patient suffering from macular degeneration, comprising administering to the patient a pharmaceutical composition comprising a therapeutically effective amount of one or more RTP801L inhibitor. In one embodiment the inhibitor is an siRNA molecule, an antisense molecule, or a ribozyme or a combination thereof.

Another embodiment of the present invention concerns a method for treating a patient suffering from a microvascular disorder, comprising administering to the patient a pharmaceutical composition comprising a therapeutically effective amount of one or more RTP801L inhibitor. In one embodiment the inhibitor is an siRNA molecule, an antisense molecule, or a ribozyme or a combination thereof.

An additional embodiment of the present invention provides for the use of a therapeutically effective amount of an RTP801L inhibitor for the preparation of a medicament for promoting recovery in a patient suffering from a respiratory disorder. In one embodiment the respiratory disorder is COPD and the inhibitor is preferably one or more siRNA. In another embodiment the respiratory disorder is ALI and the inhibitor is preferably one or more siRNA.

An additional embodiment of the present invention provides for the use of a therapeutically effective dose of one or more RTP801L inhibitor for the preparation of a medicament for promoting recovery in a patient suffering from macular degeneration. In one embodiment the macular degeneration is AMD and the inhibitor is preferably one or more siRNA.

An additional embodiment of the present invention provides for the use of a therapeutically effective dose of one or more RTP801L inhibitor for the preparation of a medicament for promoting recovery in a patient suffering from glaucoma. In one embodiment the inhibitor is preferably one or more siRNA. In various embodiments the present invention is useful in therapy for treating a patient in need of neuroprotection. In some embodiments the siRNA compound is therapeutically effective in neuroprotection of the optic nerve.

An additional embodiment of the present invention provides for the use of a therapeutically effective dose of one or more RTP801L inhibitor for the preparation of a medicament for promoting recovery in a patient suffering from an eye disorder secondary to diabetes. In one embodiment the inhibitor is preferably one or more siRNA.

An additional embodiment of the present invention provides for the use of a therapeutically effective amount of one or more RTP801L inhibitor for the preparation of a medicament for promoting recovery in a patient suffering from a microvascular disorder. In one embodiment the microvascular disorder is diabetic retinopathy and the inhibitor is preferably one or more siRNA. In another embodiment the disorder is Acute Renal Failure and the inhibitor is preferably one or more siRNA.

The present invention also relates generally to methods and compositions for treating or preventing the incidence or severity of hearing impairment (or balance impairment), particularly hearing impairment associated with cell death of the inner ear hair cells. The methods and compositions involve administering to a mammal in need of such treatment a prophylactically or therapeutically effective amount of one or more compounds which down-regulate expression of the RTP801L gene, particularly novel small interfering RNAs (siRNAs).

More specifically, the present invention provides methods and compositions for treating a patient suffering from hearing impairment, or other oto-pathologies associated with cell death of inner ear hair cells. Such oto-pathologies may be the result of acoustic trauma, mechanical trauma, age (presbycusis) or ototoxin-induced hearing loss. The methods of the invention comprising administering to the patient one or more compounds which down-regulate expression of the RTP801L gene, particularly siRNAs that inhibit RTP801L typically as a pharmaceutical composition, in a therapeutically effective dose so as to thereby treat the patient.

In one embodiment, the present invention provides for improved compositions and methods for treatments requiring administration of a pharmaceutical drug having an ototoxic, hearing-impairing side-effect, in combination with a therapeutically effective amount of one or more siRNA molecules that inhibit RTP801L, to treat or prevent the ototoxicity induced by the pharmaceutical drug. The compositions of the invention can be administered at a suitable interval(s) either prior to, subsequent to, or substantially concurrent with the administration of the ototoxic, hearing-impairing drug that induces inner ear apoptotic tissue damage.

Accordingly, it is an object of the invention to provide an improved composition containing a therapeutically effective amount of one or more siRNA molecules that inhibit RTP801L in combination with an ototoxic, hearing-impairing pharmaceutical drug for administration to a mammal. Said combination drugs may be administered separately; the siRNA molecules that inhibit RTP801L would then be administered locally while the ototoxic, hearing-impairing pharmaceutical drug is administered systemically. The siRNA molecules may be administered prior to, simultaneously with or subsequent to the ototoxic drug. Such combination compositions can further contain a pharmaceutically acceptable carrier. The pharmaceutical composition will have lower ototoxicity than the ototoxic pharmaceutical alone, and preferably, will have a higher dosage of the ototoxic pharmaceutical than typically used. Examples of such improved compositions include cisplatin or other ototoxic neoplastic agent or an aminoglycoside antibiotic(s) in combination with the therapeutically effective amount of one or more siRNA molecules that inhibit RTP801L.

Still further, the invention relates to the use of the compositions of the invention in cases where diuretics are needed. The present invention provides a solution to the art that has long sought a therapy and a medicament which can treat the ototoxic effects currently associated with certain diuretics, and particular with the more popular and commonly used loop-diuretics, without sacrificing their diuretic effectiveness.

Still further, the invention relates to the use of the compositions of the invention in cases where quinine or quinine-like compounds are needed. The present invention provides a solution to the art that has long sought a therapy and a medicament which can treat the ototoxic effects currently associated with certain quinines without sacrificing their effectiveness.

The present invention further relates to methods and compositions for treating or preventing the incidence or severity of pressure sores. The methods and compositions involve administering to a mammal in need of such treatment a prophylactically or therapeutically effective amount of one or more compounds which down-regulate expression of the RTP801L gene, particularly novel small interfering RNAs (siRNAs).

Further, the present invention relates to methods and compositions for the treatment of any ischemic or ischemia-reperfusion injuries or conditions, as described herein. Said methods and compositions involve administering to a mammal in need of such treatment a prophylactically or therapeutically effective amount of one or more compounds which down-regulate expression of the RTP801L gene, particularly novel small interfering RNAs (siRNAs).

BRIEF DESCRIPTION OF THE FIGURES

FIG. 1 provides the polynucleotide sequence of REDD2 full length mRNA (SEQ ID NO:1);

FIG. 2 provides Table F, a list of certain preferred siRNA RTP801L oligonucleotide pairs.

FIG. 3a-3c provide Table G, a list of certain preferred chemically modified RTP801L siRNA. "r" preceeding A, C, G or U refers to an unmodified ribonucleotide; "m" preceeding A, C, G or U refers to a 2'OMe modified ribonucleotide; LdC refers to L-deoxycytidine, which substituted some of the A, C, G or U in the sense strands.

FIG. 8 Shows structure, activity and stability results for certain RTP801L siRNA compounds of the present invention. Lower case italic "c" refers to L-deoxycytidine, which substituted some of the A, C, G or U in the sense strands.

DETAILED DESCRIPTION OF THE INVENTION

Figure 4:
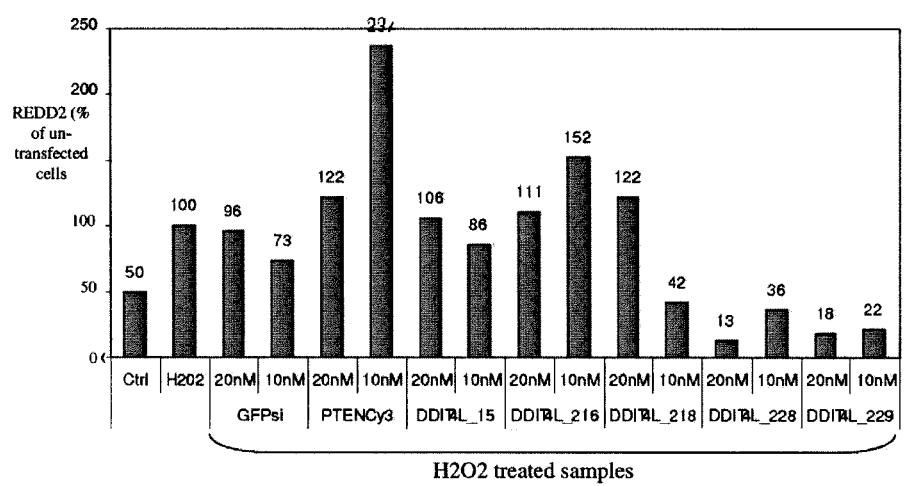
FIG. 4 details the activity results of RTP801L siRNAs on the endogenous RTP801L gene in wild type MEF cells following $H_2O_2$ treatment.
Figure 5:
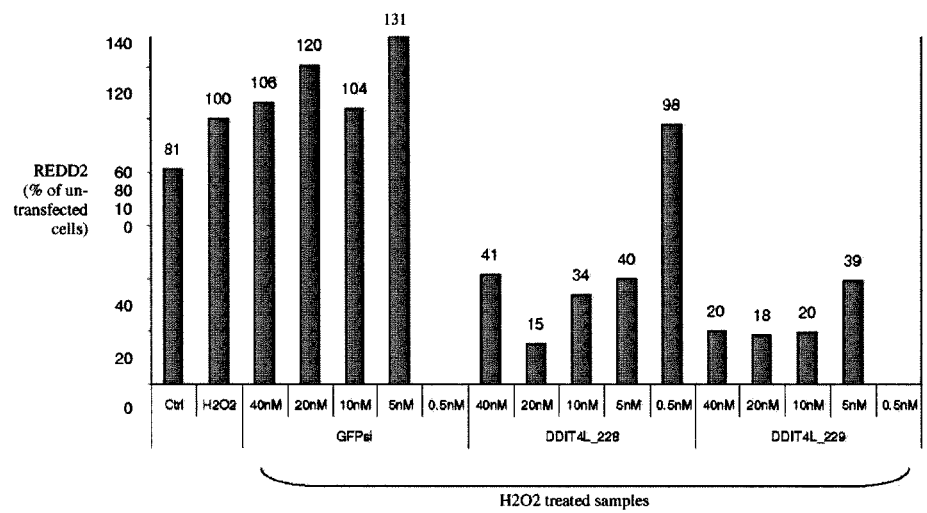
FIG. 5 demonstrates dose dependent activity of RTP801L siRNAs as measured in 801 wt MEF cells.
Figure 6:
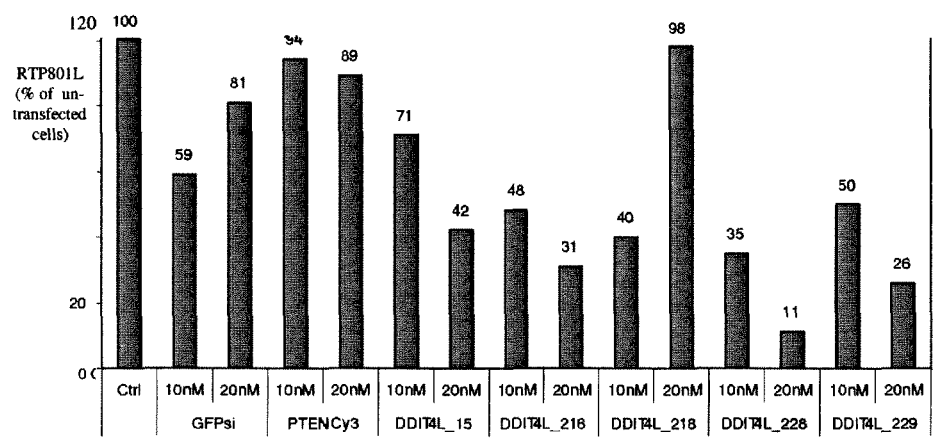
FIG. 6 shows activity results of RTP801L siRNAs on the endogenous RTP801L gene in wt 293 T cells.
Figure 7:
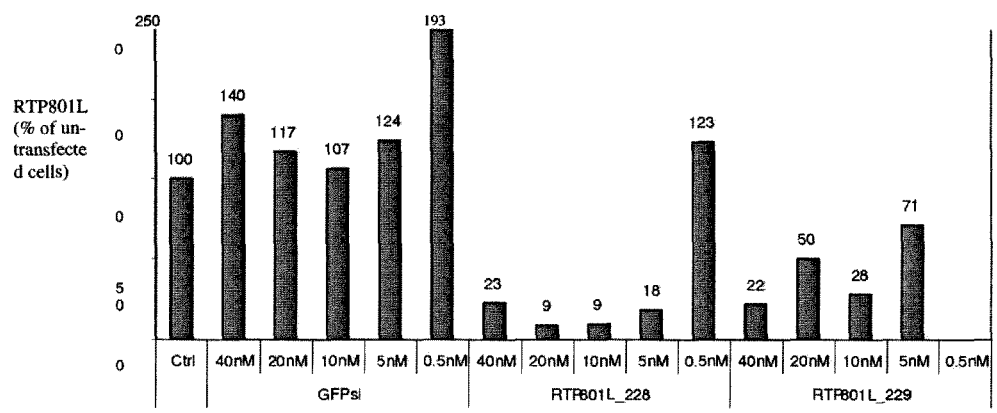
FIG. 7 demonstrates dose dependent activity of RTP801L siRNA as measured in 293T cells.
Figure 9:
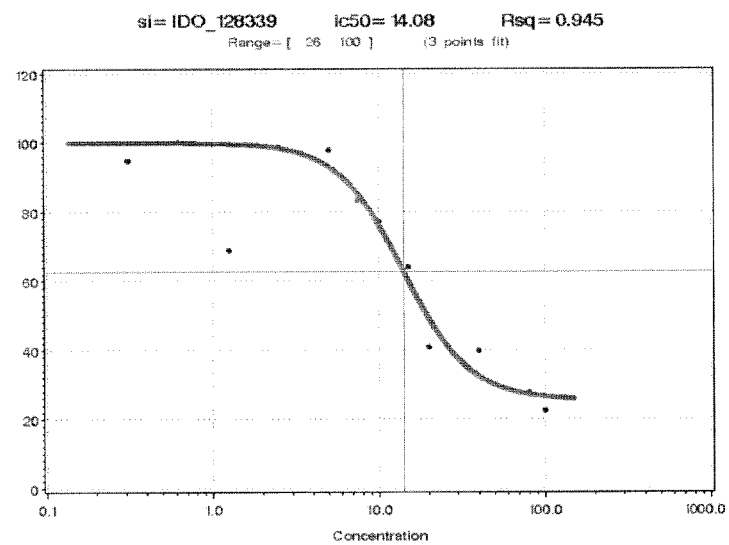
FIG. 9 shows IC50 results for an siRNA compound of the present invention.

The present invention, relates to novel oligonucleotide compounds useful in inhibiting the RTP801L gene for the treatment of eye diseases, respiratory disorders, microvascular disorders, hearing disorders and ischemic conditions, inter alia. As will be described herein, the preferred inhibitors to be used with the present invention are chemically modified siRNA.

Compounds and compositions comprising same which inhibit RTP801L are discussed herein at length, and any of said compounds and/or compositions may be beneficially employed in the treatment of a patient suffering from a disease or disorder associated with RTP801L expression.

The siRNAs of the present invention possess structures and modifications which may increase activity, increase stability, and or minimize toxicity; the novel modifications of the siRNAs of the present invention can be beneficially applied to double stranded RNA useful in preventing or attenuating RTP801L expression.

According to one aspect the present invention provides inhibitory oligonucleotide compounds comprising unmodified and modified nucleotides and or unconventional moieties. The compound comprises at least one modified nucleotide selected from the group consisting of a sugar modification, a base modification and an internucleotide linkage modification and may contain DNA, and modified nucleotides such as LNA (locked nucleic acid), ENA (ethylene-bridged nucleic acid), PNA (peptide nucleic acid), arabinoside, PACE, mirror nucleotide, or nucleotides with a 6 carbon sugar.

In one embodiment the compound comprises a 2' modification on the sugar moiety of at least one ribonucleotide ("2' sugar modification"). In certain embodiments the compound comprises 2'O-alkyl or 2'-fluoro or 2'O-allyl or any other 2' modification, optionally on alternate positions. Other stabilizing modifications are also possible (e.g. terminal modifications). In some embodiments the backbone of the oligonucleotides is modified and comprises phosphate-D-ribose entities but may also contain thiophosphate-D-ribose entities, triester, thioate, 2'-5' bridged backbone (also may be referred to as 5'-2'), PACE or any other type of modification.

Other modifications include terminal modifications on the 5' and/or 3' part of the oligonucleotides. Such terminal modifications may be lipids, peptides, sugars or other molecules.

Further, an additional embodiment of the present invention concerns a method for treating a patient suffering from a microvascular disorder, an eye disease, a respiratory disorder, a hearing disorder or a spinal cord injury or other wound, comprising administering to the patient a pharmaceutical composition comprising a therapeutically effective dose of an RTP801L inhibitor comprising an siRNA molecule, optionally an siRNA molecule detailed in any one of Tables A-G, in a dosage and over a period of time so as to thereby treat the patient.

An additional method for treating a patient suffering from a microvascular disorder, an eye disease, a respiratory disorder, a hearing disorder or a spinal cord injury or other wound is provided, comprising administering to the patient a pharmaceutical composition comprising a therapeutically effective dose of an RNA molecule which targets the RTP801L gene mRNA in a dosage and over a period of time so as to thereby treat the patient. The RNA molecule may be an siRNA molecule, such as an siRNA molecule detailed in any one of Tables A-G, preferably siRNA Nos:72 or 73. In one embodiment, the compound consists of an antisense strand having an oligomer sequence set forth in SEQ ID NO:6914 and a sense strand having an oligomer sequence set forth in SEQ ID NO:6898 (DDIT4L__14 in Table F). According to another embodiment, the compound consists of an antisense strand having an oligomer sequence set forth in SEQ ID NO:6915 and a sense strand having an oligomer sequence set forth in SEQ ID NO:6899 (DDIT4L__15 in Table F). In certain preferred embodiments the siRNA is modified so at to have antisense strand comprising alternating 2'OMe and unmodified ribonucleotides, and a sense strand comprising unmodified ribonucleotides and an L-DNA moiety at position 18 or at positions 17 and 18. In some embodiments the sense strand further includes a deoxyribonucleotide at position 15.

The present invention further provides a method for treating a patient suffering from a microvascular disorder, an eye disease, an ischemic disease, a kidney disorder, a respiratory disorder, a hearing disorder or a spinal cord injury or other wound or any of the conditions disclosed herein, comprising administering to the patient a pharmaceutical composition comprising a therapeutically effective dose of an siRNA molecule which targets the RTP801L gene mRNA, optionally an siRNA molecule detailed in any one of Tables A-G, in a dosage and over a period of time so as to thereby treat the patient. Further, the eye disease may be macular degeneration such as age-related macular degeneration (AMD) or glaucoma; the microvascular disorder may be diabetic retinopathy or acute renal failure; the ischemic disease may be ischemia—reperfusion or organ transplant related; the kidney disorder may be nephrotoxicity; the respiratory disorder may be COPD or ALI; and the hearing disorder may be noise—induced deafness, chemically induced deafness such as cisplatin-induced deafness or age-related deafness.

The present invention additionally relates to the use of the novel siRNAs disclosed herein in the treatment of hearing impairment in which inhibition of RTP801L expression is beneficial. In one embodiment, the present invention constitutes a method for treating a mammal having or prone to a hearing (or balance) impairment or treating a mammal prophylactically in conditions where inhibition of RTP801L expression is beneficial. The method of this embodiment of the present invention would prevent or reduce the occurrence or severity of a hearing (or balance) impairment that would result from inner ear cell injury, loss, or degeneration, in particular caused by an ototoxic agent or by aging. In this embodiment, the method of the invention includes administering a therapeutically effective amount of one or more compounds which down-regulate expression of the RTP801L gene, particularly the novel siRNAs of the present invention.

In one embodiment, it is the object of the present invention to provide a method for treating a mammal, to prevent, reduce, or treat a hearing impairment, disorder or imbalance, preferably an ototoxin-induced hearing condition, by administering to a mammal in need of such treatment a composition of the invention. One embodiment is a method for treating a hearing disorder or impairment wherein the ototoxicity results from administration of a therapeutically effective amount of an ototoxic pharmaceutical drug. Typical ototoxic drugs are chemotherapeutic agents, e.g. antineoplastic agents, and antibiotics. Other possible candidates include loop-diuretics, quinines or a quinine-like compound, and salicylate or salicylate-like compounds. These methods are especially effective when the ototoxic compound is an antibiotic, preferably an aminoglycoside antibiotic. Ototoxic aminoglycoside antibiotics include but are not limited to neomycin, paromomycin, ribostamycin, lividomycin, kanamycin, amikacin, tobramycin, viomycin, gentamycin, sisomycin, netilmycin, streptomycin, dibekacin, fortimycin, and dihydrostreptomycin, or combinations thereof. Particular antibiotics include neomycin B, kanamycin A, kanamycin B, gentamycin C1, gentamycin C1a, and gentamycin C2. The methods of the invention are also effective when the ototoxic compound is a neoplastic agent such as vincristine, vinblastine, cisplatin and cisplatin-like compounds and taxol and taxol-like compounds In some embodiments aimed at treating or preventing a hearing disorder, the composition of the invention is co-administered with an ototoxin. For example, an improved method is provided for treatment of infection of a mammal by administration of an aminoglycoside antibiotic, the improvement comprising administering a therapeutically effective amount of one or more compounds which down-regulate expression of the RTP801L gene particularly novel siRNAs, to the patient in need of such treatment to reduce or prevent ototoxin-induced hearing impairment associated with the antibiotic. The compounds which reduce or prevent the ototoxin-induced hearing impairment, particularly the novel siRNAs are preferably administered locally within the inner ear. In yet another embodiment is provided an improved method for treatment of cancer in a mammal by administration of a chemotherapeutic compound, the improvement comprises administering a therapeutically effective amount of a composition of the invention to the patient in need of such treatment to reduce or prevent ototoxin-induced hearing impairment associated with the chemotherapeutic drug. In another embodiment the methods of treatment are applied to hearing impairments resulting from the administration of a chemotherapeutic agent to treat its ototoxic side effect. Ototoxic chemotherapeutic agents amenable to the methods of the invention include, but are not limited to an antineoplastic agent, including cisplatin or cisplatin-like compounds, taxol or taxol-like compounds, and other chemotherapeutic agents believed to cause ototoxin-induced hearing impairments, e.g., vincristine, an antineoplastic drug used to treat hematological malignancies and sarcomas. Cisplatin-like compounds include carboplatin (Paraplatin®), tetraplatin, oxaliplatin, aroplatin and transplatin inter alia. In another embodiment the methods of the invention are applied to hearing impairments resulting from the administration of quinine and its synthetic substitutes, typically used in the treatment of malaria, to treat its ototoxic side-effect. In another embodiment the methods of the invention are applied to hearing impairments resulting from administration of a diuretic. Diuretics, particularly "loop" diuretics, i.e. those that act primarily in the Loop of Henle, are candidate ototoxins. Illustrative examples, not limiting to the invention method, include furosemide, ethacrylic acid, and mercurials. Diuretics are typically used to prevent or eliminate edema. Diuretics are also used in nonedematous states for example hypertension, hypercalcemia, idiopathic hypercalciuria, and nephrogenic diabetes insipidus.

In another embodiment, the methods of the invention are applied to treating or preventing the incidence or severity of pressure sores. The methods and compositions involve administering to a mammal in need of such treatment a prophylactically or therapeutically effective amount of one or more compounds which down-regulate expression of the RTP801L gene, particularly novel small interfering RNAs (siRNAs). The compounds which treat or prevent the incidence or severity of pressure sores, particularly the novel siRNAs are preferably administered locally within the damaged area. The methods and compositions of the present invention are effective in the treatment and prevention of pressure sores or pressure ulcers developed when sustained pressure (usually from a bed or wheelchair) cuts off circulation to vulnerable parts of the body. The methods and compositions are effective in patients with diminished or absent sensation or who are debilitated, emaciated, paralyzed, or long bedridden. The compositions of the present invention are effective also in improving the healing of pressure sores using the compositions. The compositions may be used at any particular stage in the healing process including the stage before any healing has initiated or even before a specific sore is made (prophylactic treatment).

Other kinds of wounds to be treated according to the invention include i) general wounds such as, e.g., surgical, traumatic, infectious, ischemic, thermal, chemical and bullous wounds; ii) wounds specific for the oral cavity such as, e.g., post-extraction wounds, endodontic wounds especially in connection with treatment of cysts and abscesses, ulcers and lesions of bacterial, viral or autoimmunological origin, mechanical, chemical, thermal, infectious and lichenoid wounds; herpes ulcers, stomatitis aphthosa, acute necrotising ulcerative gingivitis and burning mouth syndrome are specific examples; and iii) wounds on the skin such as, e.g., neoplasm, burns (e.g. chemical, thermal), lesions (bacterial, viral, autoimmunological), bites and surgical incisions.

The methods and compositions of the present invention are also effective in the treatment and prevention of any chronic wounds including inter alia pressure sores, venous ulcers, and diabetic ulcers. In all these chronic wound types, the underlying precipitating event is a period of ischemia followed by a period of reperfusion. These ischemia-reperfusion events are usually repetitive, which means the deleterious effects of ischemia-reperfusion are potentiated and eventually sufficient to cause ulceration. For both pressure sores and diabetic foot ulcers, the ischemic event is the result of prolonged pressure sufficient to prevent tissue perfusion, and when the pressure is finally relieved, the reperfusion injury occurs. The present compositions are effective in inhibiting the damage caused by ischemia-reperfusion in chronic wounds.

The present compositions are also effective in other conditions associated with ischemia-reperfusion such as but not limited to: organ transplantation, intestinal and colon anastamoses, operations on large blood vessels, stitching detached limbs, balloon angioplasty or any cardiac surgery, stroke or brain trauma, limb transplantation, pulmonary hypertension, hypoxemia, and noncardiogenic pulmonary edema, acute renal failure, acute glaucoma, diabetic retinopathy, hypertensive retinopathy, and retinal vascular occlusion, cochlear ischemia, microvascular surgery and ischemic lesions in scleroderma.

The methods and compositions of the present invention are also effective in the treatment of acoustic trauma or mechanical trauma, preferably acoustic or mechanical trauma that leads to inner ear hair cell loss. Acoustic trauma to be treated in the present invention may be caused by a single exposure to an extremely loud sound, or following long-term exposure to everyday loud sounds above 85 decibels. Mechanical inner ear trauma to be treated in the present invention is for example the inner ear trauma following an operation of electronic device insertion in the inner ear. The compositions of the present invention prevent or minimize the damage to inner ear hair cells associated with the operation. The compounds which reduce or prevent the ototoxin-induced hearing impairment, particularly the novel siRNAs are preferably administered locally within the inner ear.

Additionally, as detailed above, the compound of the present invention can be used to treat any condition in which ischemia is involved, optionally ischemia-reperfusion. Such condition include ischemia or ischemia-reperfusion resulting from an angioplasty, cardiac surgery or thrombolysis; organ transplant; as a result of plastic surgery; during severe compartment syndrome; during re-attachment of severed limbs; as a result of multiorgan failure syndrome; in the brain as a result of stroke or brain trauma; in connection with chronic wounds such as pressure sores, venous ulcers and diabetic ulcers; during skeletal muscle ischemia or limb transplantation; as a result of mesenteric ischemia or acute ischemic bowel disease; respiratory failure as a result of lower torso ischemia, leading to pulmonary hypertension, hypoxemia, and noncardiogenic pulmonary edema; acute renal failure as observed after renal transplantation, major surgery, trauma, and septic as well as hemorrhagic shock; Sepsis; Retinal ischemia occurring as a result of acute vascular occlusion, leading to loss of vision in a number of ocular diseases such as acute glaucoma, diabetic retinopathy, hypertensive retinopathy, and retinal vascular occlusion; Cochlear ischemia; flap failure in microvascular surgery for head and neck defects; Raynaud's phenomenon and the associated digital ischemic lesions in scleroderma; spinal cord injury; vascular surgery; Traumatic rhabdomyolysis (crush syndrome); and myoglobinuria. Further, ischemia/reperfusion may be involved in the following conditions: hypertension, hypertensive cerebral vascular disease, rupture of aneurysm, a constriction or obstruction of a blood vessel—as occurs in the case of a thrombus or embolus, angioma, blood dyscrasias, any form of compromised cardiac function including cardiac arrest or failure, systemic hypotension, cardiac arrest, cardiogenic shock, septic shock, spinal cord trauma, head trauma, seizure, bleeding from a tumor; and diseases such as stroke, Parkinson's disease, epilepsy, depression, ALS, Alzheimer's disease, Huntington's disease and any other disease-induced dementia (such as HIV induced dementia for example). Additionally, an ischemic episode may be caused by a mechanical injury to the Central Nervous System, such as results from a blow to the head or spine. Trauma can involve a tissue insult such as an abrasion, incision, contusion, puncture, compression, etc., such as can arise from traumatic contact of a foreign object with any locus of or appurtenant to the head, neck, or vertebral column. Other forms of traumatic injury can arise from constriction or compression of CNS tissue by an inappropriate accumulation of fluid (for example, a blockade or dysfunction of normal cerebrospinal fluid or vitreous humor fluid production, turnover, or volume regulation, or a subdural or intracranial hematoma or edema). Similarly, traumatic constriction or compression can arise from the presence of a mass of abnormal tissue, such as a metastatic or primary tumor.

"Treating a disease" refers to administering a therapeutic substance effective to ameliorate symptoms associated with a disease, to lessen the severity or cure the disease, or to prevent the disease from occurring. "Treatment" refers to both therapeutic treatment and prophylactic or preventative measures, wherein the object is to prevent or slow down (lessen) a disease or disorder.

A "therapeutically effective dose" refers to an amount of a pharmaceutical compound or composition which is effective to achieve an improvement in a patient or his physiological systems including, but not limited to, improved survival rate, more rapid recovery, or improvement or elimination of symptoms, and other indicators as are selected as appropriate determining measures by those skilled in the art.

The methods of treating the diseases disclosed herein and included in the present invention may include administering an RTP801L inhibitor in conjunction with an additional RTP801L inhibitor, a substance which improves the pharmacological properties of the active ingredient as detailed below, or an additional compound known to be effective in the treatment of the disease to be treated, such as macular degeneration, glaucoma, COPD, ALI, ARF, DR, cisplatin-induced deafness, and age-related deafness, inter alia. By "in conjunction with" is meant prior to, simultaneously or subsequent to. Further detail on exemplary conjoined therapies is given below.

In another embodiment, the present invention provides for the use of a therapeutically effective dose of an RTP801L inhibitor for the preparation of a medicament for promoting recovery in a patient suffering from macular degeneration, glaucoma, COPD, ALI, ARF, DR, cisplatin-induced deafness, age-related deafness or any eye disease, microvascular or respiratory condition or hearing disorder as detailed above, and the use of a therapeutically effective dose of an RTP801L inhibitor for the preparation of a medicament for treating said diseases and conditions. In this embodiment, the RTP801L inhibitor may comprise a polynucleotide which comprises consecutive nucleotides having a sequence which comprises an antisense sequence to the sequence set forth in FIG. 1 (SEQ ID No: 1). Additionally, the RTP801L inhibitor may be an expression vector comprising a polynucleotide having a sequence which is an antisense sequence to the sequence set forth in FIG. 1 (SEQ ID No:1). Additionally, the RTP801L inhibitor may be an RNA molecule which targets the RTP801L gene mRNA such as a ribozyme or an siRNA, optionally an siRNA comprising consecutive nucleotides having a sequence identical to any one of the sequences set forth in any one of Tables A-G (SEQ ID NOs:3-6927) and preferably, siRNA Nos:72 and 73 of Table A, or DDIT4L__14 or DDIT4L__15 in Table F.

Thus, according to the information disclosed herein, the RTP801L inhibitor to be used with any of the methods disclosed herein, in any of the uses disclosed herein and in any of the pharmaceutical compositions disclosed herein, may be selected from the group consisting of an siRNA molecule, a vector comprising an siRNA molecule, a vector which can express an siRNA molecule and any molecule which is endogenously processed into an siRNA molecule. As detailed herein, said siRNA molecule is preferably an siRNA comprising consecutive nucleotides having a sequence identical to any one of the sequences set forth in any one of Tables A-G and preferably siRNA Nos:72 and 73 of Table A, or DDIT4L__14 or DDIT4L__15 in Table F.

"Respiratory disorder" refers to conditions, diseases or syndromes of the respiratory system including but not limited to pulmonary disorders of all types including chronic obstructive pulmonary disease (COPD), acute lung injury (ALI), emphysema, chronic bronchitis, asthma and lung cancer, inter alia. Emphysema and chronic bronchitis may occur as part of COPD or independently. Conditions resulting from lung transplantation may also be viewed as such.

"Ischemic diseases/conditions" relates to any disease in which ischemia is involved, as well as ischemia-reperfusion injury and ischemia in connection with organ transplantation.

"Microvascular disorder" refers to any condition that affects microscopic capillaries and lymphatics, in particular vasospastic diseases, vasculitic diseases and lymphatic occlusive diseases. Examples of microvascular disorders include, inter alia: eye disorders such as Amaurosis Fugax (embolic or secondary to SLE), apla syndrome, Prot CS and ATIII deficiency, microvascular pathologies caused by IV drug use, dysproteinemia, temporal arteritis, anterior ischemic optic neuropathy, optic neuritis (primary or secondary to autoimmune diseases), glaucoma, von Hippel Lindau syndrome, corneal disease, corneal transplant rejection cataracts, Eales' disease, frosted branch angiitis, encircling buckling operation, uveitis including pars planitis, choroidal melanoma, choroidal hemangioma, optic nerve aplasia; retinal conditions such as retinal artery occlusion, retinal vein occlusion, retinopathy of prematurity, HIV retinopathy, Purtscher retinopathy, retinopathy of systemic vasculitis and autoimmune diseases, diabetic retinopathy, hypertensive retinopathy, radiation retinopathy, branch retinal artery or vein occlusion, idiopathic retinal vasculitis, aneurysms, neuroretinitis, retinal embolization, acute retinal necrosis, Birdshot retinochoroidopathy, long-standing retinal detachment; systemic conditions such as Diabetes mellitus, diabetic retinopathy (DR), diabetes-related microvascular pathologies (as detailed herein), hyperviscosity syndromes, aortic arch syndromes and ocular ischemic syndromes, carotid-cavernous fistula, multiple sclerosis, systemic lupus erythematosus, arteriolitis with SS-A autoantibody, acute multifocal hemorrhagic vasculitis, vasculitis resulting from infection, vasculitis resulting from Behcet's disease, sarcoidosis, coagulopathies, neuropathies, nephropathies, microvascular diseases of the kidney, acute renal failure and ischemic microvascular conditions, inter alia.

Microvascular disorders may comprise a neovascular element. The term "neovascular disorder" refers to those conditions where the formation of blood vessels (neovascularization) is harmful to the patient. Examples of ocular neovascularization include: retinal diseases (diabetic retinopathy, diabetic Macular Edema, chronic glaucoma, retinal detachment, and sickle cell retinopathy); rubeosis iritis; proliferative vitreo-retinopathy; inflammatory diseases; chronic uveitis; neoplasms (retinoblastoma, pseudoglioma and melanoma); Fuchs' heterochromic iridocyclitis; neovascular glaucoma; corneal neovascularization (inflammatory, transplantation and developmental hypoplasia of the iris); neovascularization following a combined vitrectomy and lensectomy; vascular diseases (retinal ischemia, choroidal vascular insufficiency, choroidal thrombosis and carotid artery ischemia); neovascularization of the optic nerve; and neovascularization due to penetration of the eye or contusive ocular injury. All these neovascular conditions may be treated using the compounds and pharmaceutical compositions of the present invention.

"Eye disease" refers to refers to conditions, diseases or syndromes of the eye including but not limited to any conditions involving choroidal neovascularization (CNV), wet and dry AMD, ocular histoplasmosis syndrome, angiod streaks, ruptures in Bruch's membrane, myopic degeneration, ocular tumors, retinal degenerative diseases, glaucoma, ION, and retinal vein occlusion (RVO). Some conditions disclosed herein, such as DR, which may be treated according to the methods of the present invention have been regarded as either a microvascular disorder and an eye disease, or both, under the definitions presented herein.

Hearing impairments relevant to the invention may be due to end-organ lesions involving inner ear hair cells, e.g., acoustic trauma, viral endolymphatic labyrinthitis, Meniere's disease. Hearing impairments include tinnitus, which is a perception of sound in the absence of an acoustic stimulus, and may be intermittent or continuous, wherein there is diagnosed a sensorineural loss. Hearing loss may be due to bacterial or viral infection, such as in herpes zoster oticus, purulent labyrinthitis arising from acute otitis media, purulent meningitis, chronic otitis media, sudden deafness including that of viral origin, e.g., viral endolymphatic labyrinthitis caused by viruses including mumps, measles, influenza, chicken pox, mononucleosis and adenoviruses. The hearing loss can be congenital, such as that caused by rubella, anoxia during birth, bleeding into the inner ear due to trauma during delivery, ototoxic drugs administered to the mother, erythroblastosis fetalis, and hereditary conditions including Waardenburg's syndrome and Hurler's syndrome. The hearing loss can be noise-induced, generally due to a noise greater than 85 decibels (db) that damages the inner ear. Preferably, the hearing loss is caused by aging (presbycusis) or an ototoxic drug that affects the auditory portion of the inner ear, particularly inner ear hair cells. Incorporated herein by reference are Chapters 196, 197, 198 and 199 of The Merck Manual of Diagnosis and Therapy, 14th Edition, (1982), Merck Sharp & Dome Research Laboratories, N.J. and corresponding chapters in the most recent 16th edition, including Chapters 207 and 210) relating to description and diagnosis of hearing and balance impairments.

Hearing disorders or impairments (or balance impairment) to be treated or prevented in the context of the present invention are preferably, without being bound by theory, trauma-induced deafness, age-related deafness and ototoxin-induced inner ear hair cells apoptotic damage. Those in need of treatment include those already experiencing a hearing impairment, those prone to having the impairment, and those in which the impairment is to be prevented. Without being bound by theory, the hearing impairments may be due to apoptotic inner ear hair cell damage or loss, wherein the damage or loss is caused by infection, mechanical injury, loud sound, aging, or, in particular, chemical-induced ototoxicity. Ototoxins include therapeutic drugs including antineoplastic agents, salicylates, quinines, and aminoglycoside antibiotics, contaminants in foods or medicinals, and environmental or industrial pollutants. Typically, treatment is performed to prevent or reduce ototoxicity, especially resulting from or expected to result from administration of therapeutic drugs. Preferably a therapeutically effective composition is given immediately after the exposure to prevent or reduce the ototoxic effect. More preferably, treatment is provided prophylactically, either by administration of the composition prior to or concomitantly with the ototoxic pharmaceutical or the exposure to the ototoxin.

The hearing impairment may be induced by chemotherapy. In more detail, hearing impairment may be caused by chemotherapeutic agents such as etoposide, 5-FU (5-fluorouracil), cis-platinum, doxorubicin, a ulna alkaloid, vincristine, vinblastine, vinorelbine, taxol, cyclophosphamide, ifosfamide, chlorambucil, busulfan, mechlorethamine, mitomycin, dacarbazine, carboplatinum, thiotepa, daunorubicin, idarubicin, mitoxantrone, bleomycin, esperamicin A1, dactinomycin, plicamycin, carmustine, lomustine, tauromustine, streptozocin, melphalan, dactinomycin, procarbazine, dexamethasone, prednisone, 2-chlorodeoxyadenosine, cytarabine, docetaxel, fludarabine, gemcitabine, herceptin, hydroxyurea, irinotecan, methotrexate, oxaliplatin, rituxin, semustine, epirubicin, etoposide, tomudex and topotecan, or a chemical analog of one of these chemotherapeutic agents. The chemotherapeutic agents most likely to cause hearing impairment is cisplatinum (cisplatin) and cisplatin-like compounds.

By "ototoxin" in the context of the present invention is meant a substance that through its chemical action injures, impairs or inhibits the activity of the sound receptors of the nervous system related to hearing, which in turn impairs hearing (and/or balance). In the context of the present invention, ototoxicity includes a deleterious effect on the inner ear hair cells. Ototoxic agents that cause hearing impairments include, but are not limited to, neoplastic agents such as vincristine, vinblastine, cisplatin and cisplatin-like compounds, taxol and taxol-like compounds, dideoxy-compounds, e.g., dideoxyinosine; alcohol; metals; industrial toxins involved in occupational or environmental exposure; contaminants of food or medicinals; and over-doses of vitamins or therapeutic drugs, e.g., antibiotics such as penicillin or chloramphenicol, and megadoses of vitamins A, D, or B6, salicylates, quinines and loop diuretics. By "exposure to an ototoxic agent" is meant that the ototoxic agent is made available to, or comes into contact with, a mammal. Exposure to an ototoxic agent can occur by direct administration, e.g., by ingestion or administration of a food, medicinal, or therapeutic agent, e.g., a chemotherapeutic agent, by accidental contamination, or by environmental exposure, e.g., aerial or aqueous exposure.

An "inhibitor" is a compound which is capable of reducing the expression of a gene or the activity of the product of such gene to an extent sufficient to achieve a desired biological or physiological effect. The term "inhibitor" as used herein refers to one or more of an oligonucleotide inhibitor, including siRNA, shRNA, aptamers, antisense molecules, miRNA and ribozymes, as well as antibodies. The inhibitor may cause complete or partial inhibition.

The term "inhibit" as used herein refers to reducing the expression of a gene or the activity of the product of such gene to an extent sufficient to achieve a desired biological or physiological effect. Inhibition may be complete or partial.

As used herein, the terms "polynucleotide" and "nucleic acid" may be used interchangeably and refer to nucleotide sequences comprising deoxyribonucleic acid (DNA), and ribonucleic acid (RNA). The terms should also be understood to include, as equivalents, analogs of either RNA or DNA made from nucleotide analogs. Throughout this application mRNA sequences are set forth as representing the corresponding genes.

"Oligonucleotide" or "oligomer" refers to a deoxyribonucleotide or ribonucleotide sequence from about 2 to about 50 nucleotides. Each DNA or RNA nucleotide may be independently natural or synthetic, and or modified or unmodified. Modifications include changes to the sugar moiety, the base moiety and or the linkages between nucleotides in the oligonucleotide. The compounds of the present invention encompass molecules comprising deoxyribonucleotides, ribonucleotides, modified deoxyribonucleotides, modified ribonucleotides and combinations thereof. See below for in depth description of oligonucleotides.

RTP801L mRNA sequence, refers to the mRNA sequence shown in FIG. 1 (SEQ ID NO:1), or any homologous sequence thereof preferably having at least 70% identity, more preferable 80% identity, even more preferably 90% or 95% identity. This encompasses any sequences derived from SEQ ID NO:1 which have undergone mutations, alterations or modifications as described herein. Thus, in a preferred embodiment RTP801l is encoded by a nucleic acid sequence according to SEQ. ID. NO. 1. It is also within the present invention that the nucleic acids according to the present invention are only complementary and identical, respectively, to a part of the nucleic acid coding for RTP801L as, preferably, the first stretch and first strand is typically shorter than the nucleic acid according to the present invention. It is also to be acknowledged that based on the amino acid sequence of RTP801L any nucleic acid sequence coding for such amino acid sequence can be perceived by the one skilled in the art based on the genetic code. However, due to the assumed mode of action of the nucleic acids according to the present invention, it is most preferred that the nucleic acid coding for RTP801L, preferably the mRNA thereof, is the one present in the organism, tissue and/or cell, respectively, where the expression of RTP801L is to be reduced.

"RTP801L polypeptide" refers to the polypeptide of the RTP801L gene, and is understood to include, for the purposes of the instant invention, the terms "RTP777", "DDIT4L" "REDD2", and "SMHS1", derived from any organism, optionally man, splice variants and fragments thereof retaining biological activity, and homologs thereof, preferably having at least 70%, more preferably at least 80%, even more preferably at least 90% or 95% homology thereto. In addition, this term is understood to encompass polypeptides resulting from minor alterations in the RTP801L coding sequence, such as, inter alia, point mutations, substitutions, deletions and insertions which may cause a difference in a few amino acids between the resultant polypeptide and the naturally occurring RTP801L. Polypeptides encoded by nucleic acid sequences which bind to the RTP801L coding sequence or genomic sequence under conditions of highly stringent hybridization, which are well-known in the art (for example Ausubel et al., Current Protocols in Molecular Biology, John Wiley and Sons, Baltimore, Md. (1988), updated in 1995 and 1998), are also encompassed by this term. Chemically modified RTP801L or chemically modified fragments of RTP801L are also included in the term, so long as the biological activity is retained. RTP801L preferably has or comprises an amino acid sequence according to SEQ. ID. NO. 2. It is acknowledged that there might be differences in the amino acid sequence among various tissues of an organism and among different organisms of one species or among different species to which the nucleic acid according to the present invention can be applied in various embodiments of the present invention. However, based on the technical teaching provided herein, the respective sequence can be taken into consideration accordingly when designing any of the nucleic acids according to the present invention.

Without being bound by theory, RTP801L may be a factor acting in the fine-tuning of cell response to energy disbalance. As such, it is a target suitable for treatment of any disease where cells should be rescued from apoptosis due to stressful conditions (e.g. diseases accompanied by death of normal cells) or where cells, which are adapted to stressful conditions due to changes in RTP801L expression (e.g. cancer cells), should be killed. In the latter case, RTP801L may be viewed as a survival factor for cancer cells and its inhibitors may treat cancer as a monotherapy or as sensitising drugs in combination with chemotherapy or radiotherapy. The assignee of the present invention has previously discovered gene RTP801 (see above) and molecules effective in inhibiting gene RTP801 (see co-assigned PCT publication No. WO06/023544A2 and PCT Application No. PCT/US2007/01468, hereby incorporated by reference in their entirety). Although RTP801L shares sequence and functional homology with RTP801, the assignee of the present invention has discovered that inhibition of RTP801 does not cause simultaneous inhibition of RTP801L, and vice versa. Therefore, RTP801L is an excellent target for inhibition in the conditions disclosed herein, and its inhibition is gene-specific. Tandem therapies which inhibit both RTP801 and RTP801L can have additional advantages and are discussed herein blow.

The term "amino acid" refers to a molecule which consists of any one of the 20 naturally occurring amino acids, amino acids which have been chemically modified (see below), or synthetic amino acids.

The term "polypeptide" refers to a molecule composed of two or more amino acids residues. The term includes peptides, polypeptides, proteins and peptidomimetics.

By "biological effect of RTP801L" or "RTP801L biological activity" is meant, without being bound by theory, the effect of RTP801L on apoptosis, such as apoptosis of alveolar cells in respiratory disorders; apoptosis of inner ear hair cells in hearing disorders, apoptosis of macular cells in macular degeneration, apoptosis of cells related to ischemia in any diseases or conditions, inter alia. The effect of RTP801L on apoptosis may be direct or indirect, and includes, without being bound by theory, any effect of RTP801L of induced by hypoxic or hyperoxic conditions. The indirect effect includes, but is not limited to, RTP801L binding to or having an effect on one of several molecules, which are involved in a signal transduction cascade resulting in apoptosis.

"Apoptosis" refers to a physiological type of cell death which results from activation of some cellular mechanisms, i.e. death that is controlled by the machinery of the cell. Apoptosis may, for example, be the result of activation of the cell machinery by an external trigger, e.g. a cytokine or anti-FAS antibody, which leads to cell death or by an internal signal. The term "programmed cell death" may also be used interchangeably with "apoptosis".

"Apoptosis-related disease" refers to a disease whose etiology is related either wholly or partially to the process of apoptosis. The disease may be caused either by a malfunction of the apoptotic process (such as in cancer or an autoimmune disease) or by overactivity of the apoptotic process (such as in certain neurodegenerative diseases). Many diseases in which RTP801L is involved are apoptosis-related diseases. For example, apoptosis is a significant mechanism in dry AMD, whereby slow atrophy of photoreceptor and pigment epithelium cells, primarily in the central (macular) region of retina takes place. Neuroretinal apoptosis is also a significant mechanism in diabetic retinopathy.

An "RTP801L inhibitor" is a compound which is capable of inhibiting the activity of the RTP801L gene or RTP801L gene product, particularly the human RTP801L gene or gene product. Such inhibitors include substances that affect the transcription or translation of the gene as well as substances that affect the activity of the gene product. An RTP801L inhibitor may also be an inhibitor of the RTP801L promoter. Examples of such inhibitors may include, inter alia: polynucleotides such as antisense (AS) fragments, siRNA, or vectors comprising them; catalytic RNAs such as ribozymes.

Specific siRNA RTP801L inhibitors are provided herein.

"Expression vector" refers to a vector that has the ability to incorporate and express heterologous DNA fragments in a foreign cell. Many prokaryotic and eukaryotic expression vectors are known and/or commercially available. Selection of appropriate expression vectors is within the knowledge of those having skill in the art.

The present invention also relates to functional nucleic acids comprising a double-stranded structure, their use for the manufacture of a medicament, a pharmaceutical composition comprising such functional nucleic acids and a method for the treatment of a patient.

Hypoxia has been recognised as a key element in the pathomechanism of quite a number of diseases such as stroke, emphysema and infarct which are associated with sub-optimum oxygen availability and tissue damaging responses to the hypoxia conditions. In fast-growing tissues, including tumor, a sub-optimum oxygen availability is compensated by undesired neo-angiogenesis. Therefore, at least in case of cancer diseases, the growth of vasculature is undesired.

In view of this, the inhibition of angiogenesis and vascular growth, respectively, is subject to intense research. Already today some compounds are available which inhibit undesired angiogenesis and vascular growth. Some of the more prominent compounds are those inhibiting VEGF and the VEGF receptor. In both cases, the effect of VEGF is avoided by either blocking VEGF as such, for example by using an antibody directed against VEGF such as pursued by Genentech's AVASTIN™ (monoclonal AB specific for VEGF) (Ferrara N.; *Endocr Rev.* 2004 25(4):581-611), or by blocking the corresponding receptor, i.e. the VEGF receptor (Traxler P; *Cancer Res.* 2004 64(14):4931-41; or Stadler W M et al., *Clin Cancer Res.* 2004; 10(10):3365-70).

As, however, angiogenesis and the growth of vasculature is a very basic and vital process in any animal and human being, the effect of this kind of compound has to be focused at the particular site where angiogenesis and vascular growth is actually undesired which renders appropriate targeting or delivery a critical issue in connection with this kind of therapeutic approach.

It is thus an objective of the present invention to provide further means for the treatment of diseases involving undesired growth of vasculature and angiogenesis, respectively.

By "small interfering RNA" (siRNA) is meant an RNA molecule which decreases or silences (prevents) the expression of a gene/mRNA of its endogenous cellular counterpart. The term is understood to encompass "RNA interference" (RNAi). RNA interference (RNAi) refers to the process of sequence-specific post transcriptional gene silencing in mammals mediated by small interfering RNAs (siRNAs) (Fire et al, 1998, *Nature* 391, 806). The corresponding process in plants is commonly referred to as specific post transcriptional gene silencing or RNA silencing and is also referred to as quelling in fungi. The RNA interference response may feature an endonuclease complex containing an siRNA, commonly referred to as an RNA-induced silencing complex (RISC), which mediates cleavage of single-stranded RNA having sequence complementary to the antisense strand of the siRNA duplex. Cleavage of the target RNA may take place in the middle of the region complementary to the antisense strand of the siRNA duplex (Elbashir et al 2001, *Genes Dev.,* 15, 188). For recent information on these terms and proposed mechanisms, see Bernstein E., et al., 2001 November; 7(11):1509-21; and Nishikura K.: *Cell.* 2001. 107(4):415-8. Examples of siRNA molecules which are used in the present invention are given in Tables A-G.

During recent years, RNAi has emerged as one of the most efficient methods for inactivation of genes (*Nature Reviews,* 2002, v. 3, p. 737-47; *Nature,* 2002, v. 418, p. 244-51). As a method, it is based on the ability of dsRNA species to enter a specific protein complex, where it is then targeted to the complementary cellular RNA and specifically degrades it. In more detail, dsRNAs are digested into short (17-29 bp) inhibitory RNAs (siRNAs) by type III RNAses (DICER, Drosha, etc) (*Nature,* 2001, v. 409, p. 363-6; *Nature,* 2003, 425, p. 415-9). These fragments and complementary mRNA are recognized by the specific RISC protein complex. The whole process is culminated by endonuclease cleavage of target mRNA (*Nature Reviews,* 2002, v. 3, p. 737-47; *Curr Opin Mol Ther.* 2003 5(3):217-24).

For delivery of siRNAs, see, for example, Shen et al *FEBS letters* 539: 111-114 (2003), Xia et al., *Nat Biotech* 20: 1006-1010 (2002), Reich et al., *Molec. Vision* 9: 210-216 (2003), Sorensen et al. *J. Mol. Biol.* 327: 761-766 (2003), Lewis et al., *Nat Genet.* 32: 107-108 (2002) and Simeoni et al., *NAR* 31, 11: 2717-2724 (2003). siRNA has been successfully used for inhibition in primates; for further details see Tolentino et al., 2004 *Retina* 24(1): 132-138.

A number of PCT applications have recently been published that relate to the RNAi phenomenon. These include: PCT publication WO 00/44895; PCT publication WO 00/49035; PCT publication WO 00/63364; PCT publication WO 01/36641; PCT publication WO 01/36646; PCT publication WO 99/32619; PCT publication WO 00/44914; PCT publication WO 01/29058; and PCT publication WO 01/75164.

RNA interference (RNAi) is based on the ability of dsRNA species to enter a cytoplasmic protein complex, where it is then targeted to the complementary cellular RNA and specifically degrade it. The RNA interference response features an endonuclease complex containing an siRNA, commonly referred to as an RNA-induced silencing complex (RISC), which mediates cleavage of single-stranded RNA having a sequence complementary to the antisense strand of the siRNA duplex. Cleavage of the target RNA may take place in the middle of the region complementary to the antisense strand of the siRNA duplex (Elbashir et al., *Genes Dev.,* 2001, 15(2): 188-200). In more detail, longer dsRNAs are digested into short (17-29 bp) dsRNA fragments (also referred to as short inhibitory RNAs, "siRNAs") by type III RNAses (DICER, DROSHA, etc.; Bernstein et al., *Nature,* 2001, 409(6818): 363-6; Lee et al., *Nature,* 2003, 425(6956):415-9). The RISC protein complex recognizes these fragments and complementary mRNA. The whole process is culminated by endonuclease cleavage of target mRNA (McManus & Sharp, *Nature Rev Genet,* 2002, 3(10):737-47; Paddison & Hannon, *Curr Opin Mol Ther.* 2003, 5(3):217-24). (For additional information on these terms and proposed mechanisms, see for example Bernstein et al., *RNA* 2001, 7(11):1509-21; Nishikura, *Cell* 2001, 107(4):415-8 and PCT publication WO 01/36646).

"Nucleotide" is meant to encompass deoxyribonucleotides and ribonucleotides, which may be natural or synthetic, and or modified or unmodified. Modifications include changes and substitutions to the sugar moiety, the base moiety and/or the internucleotide linkages.

All analogs of, or modifications to, a nucleotide/oligonucleotide may be employed with the present invention, provided that said analog or modification does not substantially adversely affect the function of the nucleotide/oligonucleotide. Acceptable modifications include modifications of the sugar moiety, modifications of the base moiety, modifications in the internucleotide linkages and combinations thereof.

The nucleotides can be selected from naturally occurring or synthetic modified bases. Naturally occurring bases include adenine, guanine, cytosine, thymine and uracil. Modified bases of nucleotides include inosine, xanthine, hypoxanthine, 2-aminoadenine, 6-methyl, 2-propyl and other alkyl adenines, 5-halo uracil, 5-halo cytosine, 6-aza cytosine and 6-aza thymine, pseudo uracil, 4-thiuracil, 8-halo adenine, 8-aminoadenine, 8-thiol adenine, 8-thiolalkyl adenines, 8-hydroxyl adenine and other 8-substituted adenines, 8-halo guanines, 8-amino guanine, 8-thiol guanine, 8-thioalkyl guanines, 8-hydroxyl guanine and other substituted guanines, other aza and deaza adenines, other aza and deaza guanines, 5-trifluoromethyl uracil and 5-trifluoro cytosine. Abasic nucleotides are encompassed by the present invention, as well as molecules comprising alternating RNA and DNA nucleotides.

In addition, analogs of polynucleotides can be prepared wherein the structure of one or more nucleotide is fundamentally altered and better suited as therapeutic or experimental reagents. An example of a nucleotide analog is a peptide nucleic acid (PNA) wherein the deoxyribose (or ribose) phosphate backbone in DNA (or RNA is replaced with a polyamide backbone which is similar to that found in peptides. PNA analogs have been shown to be resistant to enzymatic degradation and to have extended lives in vivo and in vitro. Mirror nucleotides ("L-nucleotides") may also be employed.

Possible modifications to the sugar residue are manifold and include 2'-O alkyl, locked nucleic acid (LNA), glycol nucleic acid (GNA), threose nucleic acid (TNA), arabinoside, altritol (ANA) and other 6-membered sugars including morpholinos, and cyclohexinyls.

Examples of siRNA compounds comprising LNA nucleotides are disclosed in Elmen et al., (NAR 2005. 33(1):439-447).

The compounds of the present invention can be synthesized using one or more inverted nucleotides, for example inverted thymidine or inverted adenine (for example see Takei, et al., 2002. JBC 277(26):23800-06.)

Certain structures include siRNA compounds having one or a plurality of 2'-5' internucleotide linkages (bridges or backbone).

In the context of the present invention, a "mirror" nucleotide also referred to as a Spiegelmer, is a nucleotide with reverse chirality to the naturally occurring or commonly employed nucleotide, i.e., a mirror image of the naturally occurring or commonly employed nucleotide. The mirror nucleotide can be a ribonucleotide (L-RNA) or a deoxyribonucleotide (L-DNA) and may further comprise at least one sugar, base and or backbone modification. U.S. Pat. No. 6,602,858 discloses nucleic acid catalysts comprising at least one L-nucleotide substitution.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetates.

Other possible backbone modifications include thioate modifications or 2'-5' bridged backbone modifications.

Additional modifications which may be present in the molecules of the present invention include nucleoside modifications such as artificial nucleic acids, peptide nucleic acid (PNA), morpholino and locked nucleic acid (LNA), glycol nucleic acid (GNA), threose nucleic acid (TNA), arabinoside, and mirror nucleoside (for example, beta-L-deoxynucleoside instead of beta-D-deoxynucleoside Further, said molecules may additionally contain modifications on the sugar, such as 2' alkyl, 2' fluoro, 2'O allyl 2' amine and 2' alkoxy. Many additional sugar modifications are discussed herein.

Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of a internucleotide linkage between two adjacent nucleotides in one strand. Any of the molecules of the present invention may contain one or more gaps and/or one or more nicks.

Further provided by the present invention is an siRNA encoded by any of the molecules disclosed herein, a vector encoding any of the molecules disclosed herein, and a pharmaceutical composition comprising any of the molecules disclosed herein or the vectors encoding them; and a pharmaceutically acceptable carrier.

Oligonucleotides

The siRNA compounds useful in the present invention include unmodified and chemically and or structurally modified compounds.

The selection and synthesis of siRNA corresponding to known genes has been widely reported; see for example Ui-Tei et al., J Biomed Biotechnol. 2006; 65052; Chalk et al., BBRC. 2004, 319(1):264-74; Sioud & Leirdal, Met. Mol Biol. 2004, 252:457-69; Levenkova et al., Bioinform. 2004, 20(3): 430-2; Ui-Tei et al., NAR. 2004, 32(3):936-48. For examples of the use and production of modified siRNA see for example Braasch et al., Biochem. 2003, 42(26):7967-75; Chiu et al., RNA. 2003, 9(9):1034-48; PCT Publication Nos. WO 2004/015107 and WO 02/44321 and U.S. Pat. Nos. 5,898,031 and 6,107,094.

Tables A-G comprise nucleic acid sequences of sense and corresponding antisense oligonucleotides useful in preparing corresponding siRNA compounds.

The present invention provides double-stranded oligonucleotides (e.g. siRNAs), which down-regulate the expression of RTP801L. A siRNA of the invention is a duplex oligoribonucleotide in which the sense strand is derived from the mRNA sequence of RTP801L, and the antisense strand is complementary to the sense strand. In general, some deviation from the target mRNA sequence is tolerated without compromising the siRNA activity (see e.g. Czauderna et al., 2003, NAR 31(11), 2705-2716). An siRNA of the invention inhibits RTP801L gene expression on a post-transcriptional level with or without destroying the mRNA. Without being bound by theory, siRNA may target the mRNA for specific cleavage and degradation and/or may inhibit translation from the targeted message.

In some embodiments the oligonucleotide according to the present invention comprises modified siRNA, having one or more of any of the modifications disclosed herein. In various embodiments the siRNA comprises an RNA duplex comprising a first strand and a second strand, whereby the first strand comprises a ribonucleotide sequence at least partially complementary to about 18 to about 40 consecutive nucleotides of a target nucleic acid which is mRNA transcribed from RTP801L, and the second strand comprises a ribonucleotide sequence at least partially complementary to the first strand and wherein said first strand or said second strand comprises a plurality of groups of modified ribonucleotides, optionally having a modification at the 2'-position of the sugar moiety whereby within each strand each group of modified ribonucleotides is flanked on one or both sides by a group of flanking nucleotides, optionally ribonucleotides, whereby each ribonucleotide forming the group of flanking ribonucleotides is selected from an unmodified ribonucleotide or a ribonucleotide having a modification different from the modification of the groups of modified ribonucleotides.

The group of modified ribonucleotides and/or the group of flanking nucleotides may comprise a number of ribonucleotides selected from the group consisting of an integer from 1 to 12. Accordingly, the group thus comprises one nucleotide, two nucleotides, three nucleotides, four nucleotides, five nucleotides, six nucleotides, seven nucleotides, eight nucleotides, nine nucleotides, ten nucleotides, eleven nucleotides or twelve nucleotides.

The groups of modified nucleotides and flanking nucleotides may be organized in a pattern on only one of the strands. In some embodiments the sense or the antisense strand comprises a pattern of modified nucleotides. In some preferred embodiments the middle ribonucleotide in the antisense strand is an unmodified nucleotide. For example, in a 19-oligomer antisense strand, ribonucleotide number 10 is unmodified; in a 21-oligomer antisense strand, ribonucleotide number 11 is unmodified; and in a 23-oligomer antisense strand, ribonucleotide number 12 is unmodified. The modifications or pattern of modification, if any, of the siRNA must be planned to allow for this. In an even numbered oligomer e.g. a 22 mer, the middle nucleotide may be number 11 or 12.

Possible modifications on the 2' moiety of the sugar residue include amino, fluoro, methoxy alkoxy, alkyl, amino, fluoro, chloro, bromo, CN, CF, imidazole, carboxylate, thioate, $C_1$ to $C_{10}$ lower alkyl, substituted lower alkyl, alkaryl or aralkyl, $OCF_3$, OCN, O-, S-, or N-alkyl; O—, S, or N-alkenyl; $SOCH_3$; $SO_2CH_3$; $ONO_2$; $NO_2$, $N_3$; heterozycloalkyl; heterozycloalkaryl; aminoalkylamino; polyalkylamino or substituted silyl, as, among others, described in European patents EP 0 586 520 B1 or EP 0 618 925 B1. One or more deoxyribonucleotides are also tolerated in the compounds of the present invention. As used herein, in the description of any strategy for the design of molecules, RNAi or any embodiment of RNAi disclosed herein, the term "end modification" means a chemical entity added to the terminal 5' or 3' nucleotide of the sense and/or antisense strand. Examples for such end modifications include, but are not limited to, 3' or 5' phosphate, inverted abasic, abasic, amino, fluoro, chloro, bromo, CN, $CF_3$, methoxy, imidazolyl, carboxylate, phosphorothioate, $C_1$ to $C_{22}$ and lower alkyl, lipids, sugars and polyaminoacids (i.e. peptides), substituted lower alkyl, alkaryl or aralkyl, $OCF_3$, OCN, O-, S-, or N-alkyl; O-, S-, or N-alkenyl; $SOCH_3$; $SO_2CH_3$; $ONO_2$; $NO_2$, $N_3$; heterocycloalkyl; heterocycloalkaryl; aminoalkylamino; polyalkylamino or substituted silyl, as, among others, described in European patents EP 0 586 520 B1 or EP 0 618 925 B1.

In some embodiments the siRNA is blunt ended, i.e. Z and Z' are absent, on one or both ends. More specifically, the siRNA may be blunt ended on the end defined by the 5'-terminus of the first strand and the 3'-terminus of the second strand, and/or the end defined by the 3'-terminus of the first strand and the 5'-terminus of the second strand.

In other embodiments at least one of the two strands may have an overhang of at least one nucleotide at the 5'-terminus; the overhang may consist of at least one deoxyribonucleotide. At least one of the strands may also optionally have an overhang of at least one nucleotide at the 3'-terminus. The overhang may consist of from about 1 to about 5 nucleotides.

The length of RNA duplex is from about 18 to about 40 ribonucleotides, preferably 19, 21 or 23 ribonucleotides. Further, the length of each strand may independently have a length selected from the group consisting of about 15 to about 40 bases, preferably 18 to 23 bases and more preferably 19, 21 or 23 ribonucleotides.

In certain embodiments the complementarity between said first strand and the target nucleic acid is perfect. In some embodiments, the strands are substantially complementary, i.e. having one, two or up to three mismatches between said first strand and the target nucleic acid. Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

In some embodiments the first strand and the second strand are linked by a loop structure, which is comprised of a non-nucleic acid polymer such as, inter alia, polyethylene glycol. Alternatively, the loop structure is comprised of a nucleic acid, including modified and non-modified ribonucleotides and modified and non-modified deoxyribonucleotides.

Further, the 5'-terminus of the first strand of the siRNA may be linked to the 3'-terminus of the second strand, or the 3'-terminus of the first strand are linked to the 5'-terminus of the second strand, said linkage being via a nucleic acid linker typically having a length between 2-100 nucleobases, preferably about 2 to about 30 nucleobases.

In preferred embodiments of the compounds of the invention having alternating ribonucleotides modified in at least one of the antisense and the sense strands of the compound, for 19 mer and 23 mer oligomers the ribonucleotides at the 5' and 3' termini of the antisense strand are modified in their sugar residues, and the ribonucleotides at the 5' and 3' termini of the sense strand are unmodified in their sugar residues. For 21 mer oligomers the ribonucleotides at the 5' and 3' termini of the sense strand are modified in their sugar residues, and the ribonucleotides at the 5' and 3' termini of the antisense strand are unmodified in their sugar residues, or may have an optional additional modification at the 3' terminus. As mentioned above, it is preferred that the middle nucleotide of the antisense strand is unmodified.

Additionally, the invention provides siRNA comprising a double stranded nucleic acid molecule wherein 1, 2, or 3 of the nucleotides in one strand or both strands are substituted thereby providing at least one base pair mismatch. The substituted nucleotides in each strand are preferably in the terminal region of one strand or both strands.

According to one preferred embodiment of the invention, the antisense and the sense strands of the oligonucleotide/siRNA are phosphorylated only at the 3'-terminus and not at the 5'-terminus. According to another preferred embodiment of the invention, the antisense and the sense strands are non-phosphorylated. According to yet another preferred embodiment of the invention, the 5' most ribonucleotide in the sense strand is modified to abolish any possibility of in vivo 5'-phosphorylation.

Any siRNA sequence disclosed herein can be prepared having any of the modifications/structures disclosed herein. The combination of sequence plus structure is novel and can be used in the treatment of the conditions disclosed herein.

Other modifications have been disclosed. The inclusion of a 5'-phosphate moiety was shown to enhance activity of siRNAs in *Drosophila* embryos (Boutla, et al., *Curr. Biol.* 2001, 11:1776-1780) and is required for siRNA function in human HeLa cells (Schwarz et al., *Mol. Cell*, 2002, 10:537-48). Amarzguioui et al., (*NAR*, 2003, 31(2):589-95) showed that siRNA activity depended on the positioning of the 2'-O-methyl modifications. Holen et at (NAR. 2003, 31(9):2401-07) report that an siRNA having small numbers of 2'-O-methyl modified nucleosides gave good activity compared to wild type but that the activity decreased as the numbers of 2'-O-methyl modified nucleosides was increased. Chiu and Rana (*RNA*. 2003, 9:1034-48) teach that incorporation of 2'-O-methyl modified nucleosides in the sense or antisense strand (fully modified strands) severely reduced siRNA activity relative to unmodified siRNA. The placement of a 2'-O-methyl group at the 5'-terminus on the antisense strand was reported to severely limit activity whereas placement at the 3'-terminus of the antisense and at both termini of the sense strand was tolerated (Czauderna et al., *NAR*. 2003, 31(11):2705-16). The molecules of the present invention offer an advantage in that they are active and or stable, are non-toxic and may be formulated as pharmaceutical compositions for treatment of various diseases.

In addition, analogues of polynucleotides can be prepared wherein the structure of one or more nucleotide is fundamentally altered and better suited as therapeutic or experimental reagents.

Possible modifications to the sugar residue are manifold and include 2'-0 alkyl, locked nucleic acid (LNA), glycol nucleic acid (GNA), threose nucleic acid (TNA), arabinoside, altritol (ANA) and other, 6-membered sugars including morpholinos, and cyclohexinyls.

LNA compounds are disclosed in International Patent Publication Nos. WO 00/47599, WO 99/14226, and WO 98/39352. Examples of siRNA compounds comprising LNA nucleotides are disclosed in Elmen et al., (NAR 2005. 33(1): 439-447) and in PCT Patent Publication No. WO 2004/083430.

The compounds of the present invention can be synthesized using one or more inverted nucleotides, for example inverted thymidine or inverted adenine (for example see Takei, et al., 2002. JBC 277(26):23800-06.

Backbone modifications, such as ethyl (resulting in a phospho-ethyl triester); propyl (resulting in a phospho-propyl triester); and butyl (resulting in a phospho-butyl triester) are also possible. Other backbone modifications include polymer backbones, cyclic backbones, acyclic backbones, thiophosphate-D-ribose backbones, amidates, phosphonoacetate derivatives. Certain structures include siRNA compounds having one or a plurality of 2'-5' internucleotide linkages (bridges or backbone).

The term "unconventional moiety" as used herein refers to abasic ribose moiety, an abasic deoxyribose moiety, a deoxyribonucleotide, a modified deoxyribonucleotide, a mirror nucleotide, a non-base pairing nucleotide analog and a nucleotide joined to an adjacent nucleotide by a 2'-5' internucleotide phosphate bond; bridged nucleic acids including LNA and ethylene bridged nucleic acids.

The term "capping moiety" as used herein includes abasic ribose moiety, abasic deoxyribose moiety, modifications abasic ribose and abasic deoxyribose moieties including 2' O alkyl modifications; inverted abasic ribose and abasic deoxyribose moieties and modifications thereof; C6-imino-Pi; a mirror nucleotide including L-DNA and L-RNA; 5'OMe nucleotide; and nucleotide analogs including 4',5'-methylene nucleotide; 1-(β-D-erythrofuranosyl)nucleotide; 4'-thio nucleotide, carbocyclic nucleotide; 5'-amino-alkyl phosphate; 1,3-diamino-2-propyl phosphate, 3-aminopropyl phosphate; 6-aminohexyl phosphate; 12-aminododecyl phosphate; hydroxypropyl phosphate; 1,5-anhydrohexitol nucleotide; alpha-nucleotide; threo-pentofuranosyl nucleotide; acyclic 3',4'-seco nucleotide; 3,4-dihydroxybutyl nucleotide; 3,5-dihydroxypentyl nucleotide, 5'-5'-inverted abasic moiety; 1,4-butanediol phosphate; 5'-amino; and bridging or non bridging methylphosphonate and 5'-mercapto moieties.

Abasic deoxyribose moiety includes for example abasic deoxyribose-3'-phosphate; 1,2-dideoxy-D-ribofuranose-3-phosphate; 1,4-anhydro-2-deoxy-D-ribitol-3-phosphate. Inverted abasic deoxyribose moiety includes inverted deoxyriboabasic; 3',5' inverted deoxyriboabasic 5'-phosphate.

Mirror nucleotide includes for example L-DNA (L-deoxyriboadenosine-3'-phosphate (mirror dA); L-deoxyribocytidine-3'-phosphate (mirror dC); L-deoxyriboguanosine-3'-phosphate (mirror dG); L-deoxyribothymidine-3'-phosphate (mirror image dT)) and L-RNA (L-riboadenosine-3'-phosphate (mirror rA); L-ribocytidine-3'-phosphate (mirror rC); L-riboguanosine-3'-phosphate (mirror rG); L-ribouracil-3'-phosphate (mirror dU).

Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

The molecules of the present invention may comprise siRNAs, synthetic siRNAs, shRNAs and synthetic shRNAs, in addition to other nucleic acid sequences or molecules which encode such molecules or other inhibitory nucleotide molecules.

The compounds of the present invention may further comprise an end modification. A biotin group may be attached to either the most 5' or the most 3' nucleotide of the first and/or second strand or to both ends. In a more preferred embodiment the biotin group is coupled to a polypeptide or a protein. It is also within the scope of the present invention that the polypeptide or protein is attached through any of the other aforementioned modifications.

The various end modifications as disclosed herein are preferably located at the ribose moiety of a nucleotide of the nucleic acid according to the present invention. More particularly, the end modification may be attached to or replace any of the OH-groups of the ribose moiety, including but not limited to the 2'OH, 3'OH and 5'OH position, provided that the nucleotide thus modified is a terminal nucleotide. Inverted abasic or abasic are nucleotides, either deoxyribonucleotides or ribonucleotides which do not have a nucleobase moiety. This kind of compound is, inter alia, described in Sternberger, et al., (Antisense Nucleic Acid Drug Dev, 2002.12, 131-43).

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks. Further provided by the present invention is an siRNA encoded by any of the molecules disclosed herein, a vector encoding any of the molecules disclosed herein, and a pharmaceutical composition comprising any of the molecules disclosed herein or the vectors encoding them; and a pharmaceutically acceptable carrier.

Particular molecules to be administered according to the methods of the present invention are disclosed below under the heading "structural motifs". For the sake of clarity, any of these molecules can be administered according to any of the methods of the present invention.

Structural Motifs

According to the present invention the siRNA compounds are chemically and or structurally modified according to one of the following modifications set forth in Structures (A)-(P) or as tandem siRNA or RNAstar.

In one aspect the present invention provides a compound set forth as Structure (A):

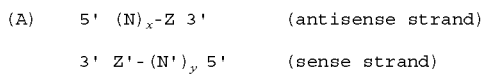

(A)    5'  $(N)_x$-Z 3'       (antisense strand)

3'  Z'-$(N')_y$ 5'     (sense strand)

wherein each of N and N' is a nucleotide selected from an unmodified ribonucleotide, a modified ribonucleotide, an unmodified deoxyribonucleotide and a modified deoxyribonucleotide;
wherein each of $(N)_x$ and $(N')_y$ is an oligonucleotide in which each consecutive N or N' is joined to the next N or N' by a covalent bond;
wherein each of x and y is an integer between 18 and 40;
wherein each of Z and Z' may be present or absent, but if present is 1-5 consecutive nucleotides covalently attached at the 3' terminus of the strand in which it is present; and
and wherein the sequence of $(N)_x$ comprises an antisense sequence substantially complementary to about 18 to about 40 consecutive ribonucleotides in an mRNA transcribed from the RTP801L gene.

In certain embodiments the present invention provides a compound having structure B (structures having alternating 2'-O-methyl modification in both strands):

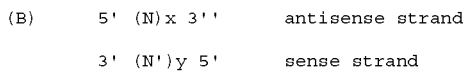

(B)    5'  (N)x 3''     antisense strand

3'  (N')y 5'     sense strand wherein each of $(N)_x$ and $(N')_y$ is an oligonucleotide in which each consecutive N or N' is an unmodified ribonucleotide or a modified ribonucleotide joined to the next N or N' by a covalent bond;
wherein each of x and y=19, 21 or 23 and $(N)_x$ and $(N')_y$ are fully complementary
wherein alternating ribonucleotides in each of $(N)_x$ and $(N')_y$ are modified to result in a 2'-O-methyl modification in the sugar residue of the ribonucleotides;
wherein the sequence of $(N')_y$ is a sequence complementary to (N)x; and wherein the sequence of $(N)_x$ comprises an antisense sequence substantially complementary to about 18 to about 40 consecutive ribonucleotides in an mRNA transcribed from the RTP801L gene. In some embodiments each of $(N)_x$ and $(N')_y$ is independently phosphorylated or non-phosphorylated at the 3' and 5' termini.

In certain embodiments of the invention, alternating ribonucleotides are modified in both the antisense and the sense strands of the compound.

In certain embodiments wherein each of x and y=19 or 23, each N at the 5' and 3' termini of $(N)_x$ is modified; and each N' at the 5' and 3' termini of $(N')_y$ is unmodified.

In certain embodiments wherein each of x and y=21, each N at the 5' and 3' termini of $(N)_x$ is unmodified; and each N' at the 5' and 3' termini of $(N')_y$ is modified.

In particular embodiments, when x and y=19, the siRNA is modified such that a 2%0-methyl (2'-OMe) group is present on the first, third, fifth, seventh, ninth, eleventh, thirteenth, fifteenth, seventeenth and nineteenth nucleotide of the antisense strand $(N)_x$, and whereby the very same modification, i.e. a 2'-OMe group, is present at the second, fourth, sixth, eighth, tenth, twelfth, fourteenth, sixteenth and eighteenth nucleotide of the sense strand $(N')_y$. In various embodiments these particular siRNA compounds are blunt ended at both termini.

In some embodiments, the present invention provides a compound having Structure (C):

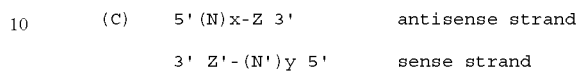

(C)    5' (N)x-Z 3'       antisense strand

3' Z'-(N')y 5'     sense strand wherein each of N and N' is a nucleotide independently selected from an unmodified ribonucleotide, a modified ribonucleotide, an unmodified deoxyribonucleotide and a modified deoxyribonucleotide;
wherein each of (N)x and (N')y is an oligomer in which each consecutive nucleotide is joined to the next nucleotide by a covalent bond and each of x and y is an integer between 18 and 40;
wherein in (N)x the nucleotides are unmodified or (N)x comprises alternating modified ribonucleotides and unmodified ribonucleotides; each modified ribonucleotide being modified so as to have a 2'-O-methyl on its sugar and the ribonucleotide located at the middle position of (N)x being modified or unmodified preferably unmodified;
wherein (N')y comprises unmodified ribonucleotides further comprising one modified nucleotide at a terminal or penultimate position, wherein the modified nucleotide is selected from the group consisting of a mirror nucleotide, a bicyclic nucleotide, a 2'-sugar modified nucleotide, an altritol nucleotide, or a nucleotide joined to an adjacent nucleotide by an internucleotide linkage selected from a 2'-5' phosphodiester bond, a P-alkoxy linkage or a PACE linkage;
wherein if more than one nucleotide is modified in (N')y, the modified nucleotides may be consecutive;
wherein each of Z and Z' may be present or absent, but if present is 1-5 deoxyribonucleotides covalently attached at the 3' terminus of any oligomer to which it is attached;
wherein the sequence of $(N')_y$ comprises a sequence substantially complementary to (N)x; and wherein the sequence of $(N)_x$ comprises an antisense sequence substantially complementary to about 18 to about 40 consecutive ribonucleotides in an mRNA transcribed from the RTP801L gene.

In particular embodiments, x=y=19 and in (N)x each modified ribonucleotide is modified so as to have a 2'-O-methyl on its sugar and the ribonucleotide located at the middle of (N)x is unmodified. Accordingly, in a compound wherein x=19, (N)x comprises 2'-O-methyl sugar modified ribonucleotides at positions 1, 3, 5, 7, 9, 11, 13, 15, 17 and 19. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 5. In other embodiments, (N)x comprises 2'O Me modified ribonucleotides at positions 2, 4, 8, 11, 13, 15, 17 and 19 and may further comprise at least one abasic or inverted abasic pseudo-nucleotide for example in position 6. In other embodiments, (N)x comprises 2'O Me modified ribonucleotides at positions 2, 4, 6, 8, 11, 13, 17 and 19 and may further comprise at least one abasic or inverted abasic pseudo-nucleotide for example in position 15. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 14. In other embodiments, (N)x comprises 2'O Me modified ribonucleotides at positions 1, 2, 3, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 1, 2, 3, 5, 7, 9, 11, 13, 15, 17 and 19 and may further comprise at least one abasic or inverted abasic pseudo-nucleotide for example in position 6. In other embodiments, (N)x comprises 2'O Me modified ribonucleotides at positions 1, 2, 3, 5, 7, 9, 11, 13, 17 and 19 and may further comprise at least one abasic or inverted abasic pseudo-nucleotide for example in position 15. In other embodiments, (N)x comprises 2'O Me modified ribonucleotides at positions 1, 2, 3, 5, 7, 9, 11, 13, 15, 17 and 19 and may further comprise at least one abasic or inverted abasic pseudo-nucleotide for example in position 14. In other embodiments, (N)x comprises 2'O Me modified ribonucleotides at positions 2, 4, 6, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 1, 2, 4, 6, 7, 9, 11, 13, 15, 17 and 19 and may further comprise at least one abasic or inverted abasic pseudo-nucleotide for example in position 5. In other embodiments, (N)x comprises 2'O Me modified ribonucleotides at positions 2, 4, 6, 8, 11, 13, 14, 16, 17 and 19 and may further comprise at least one abasic or inverted abasic pseudo-nucleotide for example in position 15. In other embodiments, (N)x comprises 2'O Me modified ribonucleotides at positions 1, 2, 3, 5, 7, 9, 11, 13, 14, 16, 17 and 19 and may further comprise at least one abasic or inverted abasic pseudo-nucleotide for example in position 15. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 7. In other embodiments, (N)x comprises 2'O Me modified ribonucleotides at positions 2, 4, 6, 11, 13, 15, 17 and 19 and may further comprise at least one abasic or inverted abasic pseudo-nucleotide for example in position 8. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 9. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 10. In other embodiments, (N)x comprises 2'O Me modified ribonucleotides at positions 2, 4, 6, 8, 13, 15, 17 and 19 and may further comprise at least one abasic or inverted abasic pseudo-nucleotide for example in position 11. In other embodiments, (N)x comprises 2'O Me modified ribonucleotides at positions 2, 4, 6, 8, 11, 13, 15, 17 and 19 and may further comprise at least one abasic or inverted abasic pseudo-nucleotide for example in position 12. In other embodiments, (N)x comprises 2'O Me modified ribonucleotides at positions 2, 4, 6, 8, 11, 15, 17 and 19 and may further comprise at least one abasic or inverted abasic pseudo-nucleotide for example in position 13.

In yet other embodiments (N)x comprises at least one nucleotide mismatch relative to the RTP801L gene. In certain preferred embodiments, (N)x comprises a single nucleotide mismatch on position 5, 6, or 14. In one embodiment of Structure (C), at least two nucleotides at either or both the 5' and 3' termini of (N')y are joined by a 2'-5' phosphodiester bond. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and three nucleotides at the 3' terminus of (N')y are joined by two 2'-5' phosphodiester bonds (set forth herein as Structure I). In other preferred embodiments, x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; and four consecutive nucleotides at the 5' terminus of (N')y are joined by three 2'-5' phosphodiester bonds. In a further embodiment, an additional nucleotide located in the middle position of (N)y may be modified with 2'-O-methyl on its sugar. In another preferred embodiment, in (N)x the nucleotides alternate between 2'-O-methyl modified ribonucleotides and unmodified ribonucleotides, and in (N')y four consecutive nucleotides at the 5' terminus are joined by three 2'-5' phosphodiester bonds and the 5' terminal nucleotide or two or three consecutive nucleotides at the 5' terminus comprise 3'-O-methyl modifications.

In certain preferred embodiments of Structure C, x=y=19 and in (N')y, at least one position comprises an abasic or inverted abasic pseudo-nucleotide, preferably five positions comprises an abasic or inverted abasic pseudo-nucleotides. In various embodiments, the following positions comprise an abasic or inverted abasic: positions 1 and 16-19, positions 15-19, positions 1-2 and 17-19, positions 1-3 and 18-19, positions 1-4 and 19 and positions 1-5. (N')y may further comprise at least one LNA nucleotide.

In certain preferred embodiments of Structure C, x=y=19 and in (N')y the nucleotide in at least one position comprises a mirror nucleotide, a deoxyribonucleotide and a nucleotide joined to an adjacent nucleotide by a 2'-5' internucleotide bond.

In certain preferred embodiments of Structure C, x=y=19 and (N')y comprises a mirror nucleotide. In various embodiments the mirror nucleotide is an L-DNA nucleotide. In certain embodiments the L-DNA is L-deoxyribocytidine. In some embodiments (N')y comprises L-DNA at position 18. In other embodiments (N')y comprises L-DNA at positions 17 and 18. In certain embodiments (N')y comprises L-DNA substitutions at positions 2 and at one or both of positions 17 and 18. In certain embodiments (N')y further comprises a 5' terminal cap nucleotide such as 5'-O-methyl DNA or an abasic or inverted abasic pseudo-nucleotide as an overhang.

In yet other embodiments (N')y comprises at least one nucleotide mismatch relative to the RTP801L gene. In certain preferred embodiments, (N')y comprises a single nucleotide mismatch on position 6, 14, or 15.

In yet other embodiments (N')y comprises a DNA at position 15 and L-DNA at one or both of positions 17 and 18. In that structure, position 2 may further comprise an L-DNA or an abasic pseudo-nucleotide.

Other embodiments of Structure C are envisaged wherein x=y=21 or wherein x=y=23; in these embodiments the modifications for (N')y discussed above instead of being on positions 15, 16, 17, 18 are on positions 17, 18, 19, 20 for 21 mer and on positions 19, 20, 21, 22 for 23 mer; similarly the modifications at one or both of positions 17 and 18 are on one or both of positions 19 or 20 for the 21 mer and one or both of positions 21 and 22 for the 23 mer. All modifications in the 19 mer are similarly adjusted for the 21 and 23 mers.

According to various embodiments of Structure (C), in (N')y 2, 3, 4, 5, 6, 7, 8, 9, 10, 11, 12, 13 or 14 consecutive ribonucleotides at the 3' terminus are linked by 2'-5' internucleotide linkages In one preferred embodiment, four consecutive nucleotides at the 3' terminus of (N')y are joined by three 2'-5' phosphodiester bonds, wherein one or more of the 2'-5' nucleotides which form the 2'-5' phosphodiester bonds further comprises a 3'-O-methyl sugar modification. Preferably the 3' terminal nucleotide of (N')y comprises a 2'-O-methyl sugar modification. In certain preferred embodiments of Structure C, x=y=19 and in (N')y two or more consecutive nucleotides at positions 15, 16, 17, 18 and 19 comprise a nucleotide joined to an adjacent nucleotide by a 2'-5' internucleotide bond. In various embodiments the nucleotide forming the 2'-5' internucleotide bond comprises a 3' deoxyribose nucleotide or a 3' methoxy nucleotide. In some embodiments the nucleotides at positions 17 and 18 in (N')y are joined by a 2'-5' internucleotide bond. In other embodiments the nucleotides at positions 16, 17, 18, 16-17, 17-18, or 16-18 in (N')y are joined by a 2'-5' internucleotide bond.

In certain embodiments (N')y comprises an L-DNA at position 2 and 2'-5' internucleotide bonds at positions 16, 17, 18, 16-17, 17-18, or 16-18. In certain embodiments (N')y comprises 2'-5' internucleotide bonds at positions 16, 17, 18, 16-17, 17-18, or 16-18 and a 5' terminal cap nucleotide.

According to various embodiments of Structure (C), in (N')y 2, 3, 4, 5, 6, 7, 8, 9, 10, 11, 12, 13 or 14 consecutive nucleotides at either terminus or 2-8 modified nucleotides at each of the 5' and 3' termini are independently mirror nucleotides. In some embodiments the mirror nucleotide is an L-ribonucleotide. In other embodiments the mirror nucleotide is an L-deoxyribonucleotide. The mirror nucleotide may further be modified at the sugar or base moiety or in an internucleotide linkage.

In one preferred embodiment of Structure (C), the 3' terminal nucleotide or two or three consecutive nucleotides at the 3' terminus of (N')y are L-deoxyribonucleotides.

In other embodiments of Structure (C), in (N')y 2, 3, 4, 5, 6, 7, 8, 9, 10, 11, 12, 13 or 14 consecutive ribonucleotides at either terminus or 2-8 modified nucleotides at each of the 5' and 3' termini are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In one series of preferred embodiments, three, four or five consecutive nucleotides at the 5' terminus of (N')y comprise the 2'-OMe modification. In another preferred embodiment, three consecutive nucleotides at the 3' terminus of (N')y comprise the 2'-O-methyl modification.

In some embodiments of Structure (C), in (N')y 2, 3, 4, 5, 6, 7, 8, 9, 10, 11, 12, 13 or 14 consecutive ribonucleotides at either or 2-8 modified nucleotides at each of the 5' and 3' termini are independently bicyclic nucleotide. In various embodiments the bicyclic nucleotide is a locked nucleic acid (LNA). A 2'-O, 4'-C-ethylene-bridged nucleic acid (ENA) is a species of LNA (see below).

In various embodiments (N')y comprises modified nucleotides at the 5' terminus or at both the 3' and 5' termini.

In some embodiments of Structure (C), at least two nucleotides at either or both the 5' and 3' termini of (N')y are joined by P-ethoxy backbone modifications. In certain preferred embodiments x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle position of (N)x being unmodified; and four consecutive nucleotides at the 3' terminus or at the 5' terminus of (N')y are joined by three P-ethoxy backbone modifications. In another preferred embodiment, three consecutive nucleotides at the 3' terminus or at the 5' terminus of (N')y are joined by two P-ethoxy backbone modifications.

In some embodiments of Structure (C), in (N')y 2, 3, 4, 5, 6, 7 or 8, consecutive ribonucleotides at each of the 5' and 3' termini are independently mirror nucleotides, nucleotides joined by 2'-5' phosphodiester bond, 2' sugar modified nucleotides or bicyclic nucleotide. In one embodiment, the modification at the 5' and 3' termini of (N')y is identical. In one preferred embodiment, four consecutive nucleotides at the 5' terminus of (N')y are joined by three 2'-5' phosphodiester bonds and three consecutive nucleotides at the 3' terminus of (N')y are joined by two 2'-5' phosphodiester bonds. In another embodiment, the modification at the 5' terminus of (N')y is different from the modification at the 3' terminus of (N')y. In one specific embodiment, the modified nucleotides at the 5' terminus of (N')y are mirror nucleotides and the modified nucleotides at the 3' terminus of (N')y are joined by 2'-5' phosphodiester bond. In another specific embodiment, three consecutive nucleotides at the 5' terminus of (N')y are LNA nucleotides and three consecutive nucleotides at the 3' terminus of (N')y are joined by two 2'-5' phosphodiester bonds. In (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified, or the ribonucleotides in (N)x being unmodified In another embodiment of Structure (C), the present invention provides a compound wherein x=y=19 or x=y=23; in (N)x the nucleotides alternate between modified ribonucleotides and unmodified ribonucleotides, each modified ribonucleotide being modified so as to have a 2'-O-methyl on its sugar and the ribonucleotide located at the middle of (N)x being unmodified; three nucleotides at the 3' terminus of (N')y are joined by two 2'-5' phosphodiester bonds and three nucleotides at the 5' terminus of (N')y are LNA such as ENA.

In another embodiment of Structure (C), five consecutive nucleotides at the 5' terminus of (N')y comprise the 2'-O-methyl sugar modification and two consecutive nucleotides at the 3' terminus of (N')y are L-DNA.

In yet another embodiment, the present invention provides a compound wherein x=y=19 or x=y=23; (N)x consists of unmodified ribonucleotides; three consecutive nucleotides at the 3' terminus of (N')y are joined by two 2'-5' phosphodiester bonds and three consecutive nucleotides at the 5' terminus of (N')y are LNA such as ENA.

According to other embodiments of Structure (C), in (N')y the 5' or 3' terminal nucleotide, or 2, 3, 4, 5 or 6 consecutive nucleotides at either termini or 1-4 modified nucleotides at each of the 5' and 3' termini are independently phosphonocarboxylate or phosphinocarboxylate nucleotides (PACE nucleotides). In some embodiments the PACE nucleotides are deoxyribonucleotides. In some preferred embodiments in (N')y, 1 or 2 consecutive nucleotides at each of the 5' and 3' termini are PACE nucleotides. Examples of PACE nucleotides and analogs are disclosed in U.S. Pat. Nos. 6,693,187 and 7,067,641 both incorporated by reference.

In additional embodiments, the present invention provides a compound having Structure (D):

(D)  5' (N)x-Z 3'      antisense strand

3' Z'-(N')y 5'    sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial identity to about 18 to about 40 consecutive ribonucleotides in an mRNA transcribed from the RTP801L gene.

In one embodiment of Structure (D), x=y=19 or x=y=23; (N)x comprises unmodified ribonucleotides in which two consecutive nucleotides linked by one 2'-5' internucleotide linkage at the 3' terminus; and (N')y comprises unmodified ribonucleotides in which two consecutive nucleotides linked by one 2'-5' internucleotide linkage at the 5' terminus.

In some embodiments, x=y=19 or x=y=23; (N)x comprises unmodified ribonucleotides in which three consecutive nucleotides at the 3' terminus are joined together by two 2'-5' phosphodiester bonds; and (N')y comprises unmodified ribonucleotides in which four consecutive nucleotides at the 5' terminus are joined together by three 2'-5' phosphodiester bonds (set forth herein as Structure II).

According to various embodiments of Structure (D) 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are linked by 2'-5' internucleotide linkages.

According to one preferred embodiment of Structure (D), four consecutive nucleotides at the 5' terminus of (N')y are joined by three 2'-5' phosphodiester bonds and three consecutive nucleotides at the 3' terminus of (N')x are joined by two 2'-5' phosphodiester bonds. Three nucleotides at the 5' terminus of (N')y and two nucleotides at the 3' terminus of (N')x may also comprise 3'-O-methyl modifications.

According to various embodiments of Structure (D), 2, 3, 4, 5, 6, 7, 8, 9, 10, 11, 12, 13 or 14 consecutive nucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently mirror nucleotides. In some embodiments the mirror is an L-ribonucleotide.

In other embodiments the mirror nucleotide is L-deoxyribonucleotide.

In other embodiments of Structure (D), 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In one preferred embodiment of Structure (D), five consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), ten consecutive nucleotides at the 5' terminus of (N')y comprise the 2'-O-methyl modification and five consecutive nucleotides at the 3' terminus of (N')x comprise the 2'-O-methyl modification. In another preferred embodiment of Structure (D), thirteen consecutive nucleotides at the 5' terminus of (N')y comprise the 2'-O-methyl modification and five consecutive nucleotides at the 3' terminus of (N')x comprise the 2'-O-methyl modification.

In some embodiments of Structure (D), in (N')y 2, 3, 4, 5, 6, 7, 8, 9, 10, 11, 12, 13 or 14 consecutive ribonucleotides starting at the ultimate or penultimate position of the 3' terminus of (N)x and 2, 3, 4, 5, 6, 7, 8, 9, 10, 11, 12, 13 or 14 consecutive ribonucleotides starting at the ultimate or penultimate position of the 5' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (D), (N')y comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a phosphodiester bond, a P-alkoxy linkage or a PACE linkage;

In various embodiments of Structure (D), (N)x comprises a modified nucleotide selected from a bicyclic nucleotide, a 2' sugar modified nucleotide, a mirror nucleotide, an altritol nucleotide or a nucleotide joined to an adjacent nucleotide by an internucleotide linkage selected from a 2'-5' phosphodiester bond, a P-alkoxy linkage or a PACE linkage;

In embodiments wherein each of the 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In one specific embodiment of Structure (D), five consecutive nucleotides at the 5' terminus of (N')y comprise the 2'-O-methyl modification and two consecutive nucleotides at the 3' terminus of (N')y are L-DNA. In addition, the compound may further comprise five consecutive 2'-O-methyl modified nucleotides at the 3' terminus of (N')x.

In various embodiments of Structure (D), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (E):

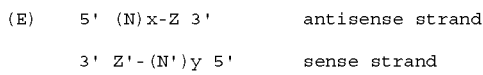

```
(E)    5' (N)x-Z 3'        antisense strand
       3' Z'-(N')y 5'      sense strand
``` wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;
wherein (N)x comprises unmodified ribonucleotides further comprising one modified nucleotide at the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein (N')y comprises unmodified ribonucleotides further comprising one modified nucleotide at the 3' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;
wherein in each of (N)x and (N')y modified and unmodified nucleotides are not alternating;
wherein each of Z and Z' may be present or absent, but if present is 1-5 deoxyribonucleotides covalently attached at the 3' terminus of any oligomer to which it is attached;
wherein the sequence of (N')$_y$ is a sequence substantially complementary to (N)x; and wherein the sequence of (N)$_x$ comprises an antisense sequence having substantial identity to about 18 to about 40 consecutive ribonucleotides in an mRNA transcribed from the RTP801L gene.

In certain preferred embodiments the ultimate nucleotide at the 5' terminus of (N)x is unmodified.

According to various embodiments of Structure (E) 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are linked by 2'-5' internucleotide linkages.

According to various embodiments of Structure (E), 2, 3, 4, 5, 6, 7, 8, 9, 10, 11, 12, 13 or 14 consecutive nucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive nucleotides starting at the ultimate or penultimate position of the 3' terminus of (N')y are independently mirror nucleotides. In some embodiments the mirror is an L-ribonucleotide. In other embodiments the mirror nucleotide is L-deoxyribonucleotide.

In other embodiments of Structure (E), 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (E), in (N')y 2, 3, 4, 5, 6, 7, 8, 9, 10, 11, 12, 13 or 14 consecutive ribonucleotides starting at the ultimate or penultimate position of the 5' terminus of (N)x, preferably starting at the 5' penultimate position, and 2, 3, 4, 5, 6, 7, 8, 9, 10, 11, 12, 13 or 14 consecutive ribonucleotides starting at the ultimate or penultimate position of the 3' terminus of (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (E), (N')y comprises modified nucleotides selected from a bicyclic nucleotide, a 2' sugar modified nucleotide, a mirror nucleotide, an altritol nucleotide, a nucleotide joined to an adjacent nucleotide by a P-alkoxy backbone modification or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In various embodiments of Structure (E), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where both 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (E), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (F):

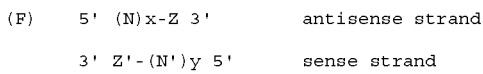

```
(F)    5' (N)x-Z 3'        antisense strand
       3' Z'-(N')y 5'      sense strand
``` wherein each of N and N' is a nucleotide selected from an unmodified ribonucleotide, a modified ribonucleotide, an unmodified deoxyribonucleotide or a modified deoxyribonucleotide;
wherein each of (N)x and (N')y is an oligomer in which each consecutive nucleotide is joined to the next nucleotide by a covalent bond and each of x and y is an integer between 18 and 40;

wherein each of (N)x and (N')y comprise unmodified ribonucleotides in which each of (N)x and (N')y independently comprise one modified nucleotide at the 3' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial identity to about 18 to about 40 consecutive ribonucleotides in an mRNA transcribed from the RTP801L gene.

In some embodiments of Structure (F), x=y=19 or x=y=23; (N')y comprises unmodified ribonucleotides in which two consecutive nucleotides at the 3' terminus comprises two consecutive mirror deoxyribonucleotides; and (N)x comprises unmodified ribonucleotides in which one nucleotide at the 3' terminus comprises a mirror deoxyribonucleotide (set forth as Structure III).

According to various embodiments of Structure (F) 2, 3, 4, 5, 6, 7, 8, 9, 10, 11, 12, 13 or 14 consecutive ribonucleotides independently beginning at the ultimate or penultimate position of the 3' termini of (N)x and (N')y are linked by 2'-5' internucleotide linkages.

According to one preferred embodiment of Structure (F), three consecutive nucleotides at the 3' terminus of (N')y are joined by two 2'-5' phosphodiester bonds and three consecutive nucleotides at the 3' terminus of (N')x are joined by two 2'-5' phosphodiester bonds.

According to various embodiments of Structure (F), 2, 3, 4, 5, 6, 7, 8, 9, 10, 11, 12, 13 or 14 consecutive nucleotides independently beginning at the ultimate or penultimate position of the 3' termini of (N)x and (N')y are independently mirror nucleotides. In some embodiments the mirror nucleotide is an L-ribonucleotide. In other embodiments the mirror nucleotide is an L-deoxyribonucleotide.

In other embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe).

In some embodiments of Structure (F), 2, 3, 4, 5, 6, 7, 8, 9, 10, 11, 12, 13 or 14 consecutive ribonucleotides independently beginning at the ultimate or penultimate position of the 3' termini of (N)x and (N')y are independently a bicyclic nucleotide. In various embodiments the bicyclic nucleotide is a locked nucleic acid (LNA) such as a 2'-O, 4'-C-ethylene-bridged nucleic acid (ENA).

In various embodiments of Structure (F), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at both the 3' and 5' termini.

In various embodiments of Structure (F), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 3' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (F), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (G):

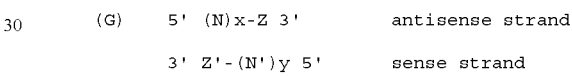

wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein each of (N)x and (N')y comprise unmodified ribonucleotides in which each of (N)x and (N')y independently comprise one modified nucleotide at the 5' terminal or penultimate position wherein the modified nucleotide is selected from the group consisting of a bicyclic nucleotide, a 2' sugar modified nucleotide, a mirror nucleotide, a nucleotide joined to an adjacent nucleotide by a P-alkoxy backbone modification or a nucleotide joined to an adjacent nucleotide by a 2'-5' phosphodiester bond;

wherein for (N)x the modified nucleotide is preferably at penultimate position of the 5' terminal;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial identity to about 18 to about 40 consecutive ribonucleotides in an mRNA transcribed from the RTP801L gene.

In some embodiments of Structure (G), x=y=19 or x=y=23.

According to various embodiments of Structure (G) 2, 3, 4, 5, 6, 7, 8, 9, 10, 11, 12, 13 or 14 consecutive ribonucleotides independently beginning at the ultimate or penultimate position of the 5' termini of (N)x and (N')y are linked by 2'-5' internucleotide linkages. For (N)x the modified nucleotides preferably starting at the penultimate position of the 5' terminal.

According to various embodiments of Structure (G), 2, 3, 4, 5, 6, 7, 8, 9, 10, 11, 12, 13 or 14 consecutive nucleotides independently beginning at the ultimate or penultimate position of the 5' termini of (N)x and (N')y are independently mirror nucleotides. In some embodiments the mirror nucleotide is an L-ribonucleotide. In other embodiments the mirror nucleotide is an L-deoxyribonucleotide. For (N)x the modified nucleotides preferably starting at the penultimate position of the 5' terminal.

In other embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are independently 2' sugar modified nucleotides. In some embodiments the 2' sugar modification comprises the presence of an amino, a fluoro, an alkoxy or an alkyl moiety. In certain embodiments the 2' sugar modification comprises a methoxy moiety (2'-OMe). In some preferred embodiments the consecutive modified nucleotides preferably begin at the penultimate position of the 5' terminus of (N)x.

In one preferred embodiment of Structure (G), five consecutive ribonucleotides at the 5' terminus of (N')y comprise a 2'-O-methyl modification and one ribonucleotide at the 5' penultimate position of (N')x comprises a 2'-O-methyl modification. In another preferred embodiment of Structure (G), five consecutive ribonucleotides at the 5' terminus of (N')y comprise a 2'-O-methyl modification and two consecutive ribonucleotides at the 5' terminal position of (N')x comprise a 2'-O-methyl modification.

In some embodiments of Structure (G), 2, 3, 4, 5, 6, 7, 8, 9, 10, 11, 12, 13 or 14 consecutive ribonucleotides independently beginning at the ultimate or penultimate position of the 5' termini of (N)x and (N')y are bicyclic nucleotides. In various embodiments the bicyclic nucleotide is a locked nucleic acid (LNA) such as a 2'-O, 4'-C-ethylene-bridged nucleic acid (ENA). In some preferred embodiments the consecutive modified nucleotides preferably begin at the penultimate position of the 5' terminus of (N)x.

In various embodiments of Structure (G), (N')y comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In various embodiments of Structure (G), (N)x comprises a modified nucleotide selected from a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage at the 5' terminus or at each of the 3' and 5' termini.

In one embodiment where each of 3' and 5' termini of the same strand comprise a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond. In various embodiments of Structure (G), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In additional embodiments, the present invention provides a compound having Structure (H):

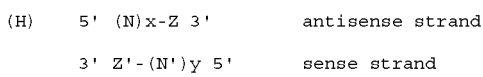

(H)  5' (N)x-Z 3'       antisense strand
     3' Z'-(N')y 5'     sense strand wherein each of N and N' is a nucleotide selected from an unmodified ribonucleotide, a modified ribonucleotide, an unmodified deoxyribonucleotide or a modified deoxyribonucleotide;

wherein each of (N)x and (N')y is an oligomer in which each consecutive nucleotide is joined to the next nucleotide by a covalent bond and each of x and y is an integer between 18 and 40;

wherein (N)x comprises unmodified ribonucleotides further comprising one modified nucleotide at the 3' terminal or penultimate position or the 5' terminal or penultimate position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein (N')y comprises unmodified ribonucleotides further comprising one modified nucleotide at an internal position, wherein the modified nucleotide is selected from the group consisting of a bicyclic nucleotide, a 2' sugar modified nucleotide, a mirror nucleotide, an altritol nucleotide, or a nucleotide joined to an adjacent nucleotide by an internucleotide linkage selected from a 2'-5' phosphodiester bond, a P-alkoxy linkage or a PACE linkage;

wherein in each of (N)x and (N')y modified and unmodified nucleotides are not alternating;

wherein each of Z and Z' may be present or absent, but if present is 1-5 deoxyribonucleotides covalently attached at the 3' terminus of any oligomer to which it is attached;

wherein the sequence of $(N')_y$ is a sequence substantially complementary to (N)x; and wherein the sequence of $(N)_x$ comprises an antisense sequence having substantial identity to about 18 to about 40 consecutive ribonucleotides in an mRNA transcribed from the RTP801L gene.

In one embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or both termini of (N)x are independently 2' sugar modified nucleotides, bicyclic nucleotides, mirror nucleotides, altritol nucleotides or nucleotides joined to an adjacent nucleotide by a 2'-5' phosphodiester bond and 2, 3, 4, 5, 6, 7, 8, 9, 10, 11, 12, 13 or 14 consecutive internal ribonucleotides in (N')y are independently 2' sugar modified nucleotides, bicyclic nucleotides, mirror nucleotides, altritol nucleotides or nucleotides joined to an adjacent nucleotide by a 2'-5' phosphodiester bond. In some embodiments the 2' sugar modification comprises the presence of an amino, a fluoro, an alkoxy or an alkyl moiety. In certain embodiments the 2' sugar modification comprises a methoxy moiety (2'-OMe).

In another embodiment of Structure (H), 2, 3, 4, 5, 6, 7, 8, 9, 10, 11, 12, 13 or 14 consecutive ribonucleotides independently beginning at the ultimate or penultimate position of the 3' terminus or the 5' terminus or 2-8 consecutive nucleotides at each of 5' and 3' termini of (N')y are independently 2' sugar modified nucleotides, bicyclic nucleotides, mirror nucleotides, altritol nucleotides or nucleotides joined to an adjacent nucleotide by a 2'-5' phosphodiester bond, and 2, 3, 4, 5, 6, 7, 8, 9, 10, 11, 12, 13 or 14 consecutive internal ribonucleotides in (N)x are independently 2' sugar modified nucleotides, bicyclic nucleotides, mirror nucleotides, altritol nucleotides or nucleotides joined to an adjacent nucleotide by a 2'-5' phosphodiester bond.

In one embodiment wherein each of 3' and 5' termini of the same strand comprises a modified nucleotide, the modification at the 5' and 3' termini is identical. In another embodiment, the modification at the 5' terminus is different from the modification at the 3' terminus of the same strand. In one specific embodiment, the modified nucleotides at the 5' terminus are mirror nucleotides and the modified nucleotides at the 3' terminus of the same strand are joined by 2'-5' phosphodiester bond.

In various embodiments of Structure (H), the modified nucleotides in (N)x are different from the modified nucleotides in (N')y. For example, the modified nucleotides in (N)x are 2' sugar modified nucleotides and the modified nucleotides in (N')y are nucleotides linked by 2'-5' internucleotide linkages. In another example, the modified nucleotides in (N)x are mirror nucleotides and the modified nucleotides in (N')y are nucleotides linked by 2'-5' internucleotide linkages. In another example, the modified nucleotides in (N)x are nucleotides linked by 2'-5' internucleotide linkages and the modified nucleotides in (N')y are mirror nucleotides.

In one preferred embodiment of Structure (H), x=y=19; three consecutive ribonucleotides at the 9-11 nucleotide positions 9-11 of (N')y comprise 2'-O-methyl modification and five consecutive ribonucleotides at the 3' terminal position of (N')x comprise 2'-O-methyl modification.

For all the above Structures (A)-(H), in various embodiments x=y and each of x and y is 19, 20, 21, 22 or 23. In certain embodiments, x=y=19. In yet other embodiments x=y=23. In additional embodiments the compound comprises modified ribonucleotides in alternating positions wherein each N at the 5' and 3' termini of (N)x are modified in their sugar residues and the middle ribonucleotide is not modified, e.g. ribonucleotide in position 10 in a 19-mer strand, position 11 in a 21 mer and position 12 in a 23-mer strand.

In some embodiments where x=y=21 or x=y=23 the position of modifications in the 19 mer are adjusted for the 21 and 23 mers with the proviso that the middle nucleotide of the antisense strand is preferably not modified.

In some embodiments, neither (N)x nor (N')y are phosphorylated at the 3' and 5' termini. In other embodiments either or both (N)x and (N')y are phosphorylated at the 3' termini. In yet another embodiment, either or both (N)x and (N')y are phosphorylated at the 3' termini using non-cleavable phosphate groups. In yet another embodiment, either or both (N)x and (N')y are phosphorylated at the terminal 2' termini position using cleavable or non-cleavable phosphate groups. These particular siRNA compounds are also blunt ended and are non-phosphorylated at the termini; however, comparative experiments have shown that siRNA compounds phosphorylated at one or both of the 3'-termini have similar activity in vivo compared to the non-phosphorylated compounds.

In certain embodiments for all the above-mentioned Structures, the compound is blunt ended, for example wherein both Z and Z' are absent. In an alternative embodiment, the compound comprises at least one 3' overhang, wherein at least one of Z or Z' is present. Z and Z' independently comprises one or more covalently linked modified or non-modified nucleotides, for example inverted dT or dA; dT, LNA, mirror nucleotide and the like. In some embodiments each of Z and Z' are independently selected from dT and dTdT. siRNA in which Z and/or Z' is present have similar activity and stability as siRNA in which Z and Z' are absent.

In certain embodiments for all the above-mentioned Structures, the compound comprises one or more phosphonocarboxylate and/or phosphinocarboxylate nucleotides (PACE nucleotides). In some embodiments the PACE nucleotides are deoxyribonucleotides and the phosphinocarboxylate nucleotides are phosphinoacetate nucleotides. Examples of PACE nucleotides and analogs are disclosed in U.S. Pat. Nos. 6,693,187 and 7,067,641, both incorporated herein by reference.

In certain embodiments for all the above-mentioned Structures, the compound comprises one or more locked nucleic acids (LNA) also defined as bridged nucleic acids or bicyclic nucleotides. Preferred locked nucleic acids are 2'-O, 4'-C-ethylene nucleosides (ENA) or 2'-O, 4'-C-methylene nucleosides. Other examples of LNA and ENA nucleotides are disclosed in WO 98/39352, WO 00/47599 and WO 99/14226, all incorporated herein by reference.

In certain embodiments for all the above-mentioned Structures, the compound comprises one or more altritol monomers (nucleotides), also defined as 1,5 anhydro-2-deoxy-D-altrito-hexitol (see for example, Allan, et al., 1998. Nucleosides & Nucleotides 17:1523-1526; Herdewijn et al., 1999. Nucleosides & Nucleotides 18:1371-1376; Fisher et al., 2007, NAR 35(4):1064-1074; all incorporated herein by reference).

The present invention explicitly excludes compounds in which each of N and/or N' is a deoxyribonucleotide (D-A, D-C, D-G, D-T). In certain embodiments (N)x and (N')y may comprise independently 1, 2, 3, 4, 5, 6, 7, 8, 9 or more deoxyribonucleotides. In certain embodiments the present invention provides a compound wherein each of N is an unmodified ribonucleotide and the 3' terminal nucleotide or 2, 3, 4, 5, 6, 7, 8, 9, 10, 11, 12, 13 or 14 consecutive nucleotides at the 3' terminus of (N')y are deoxyribonucleotides. In yet other embodiments each of N is an unmodified ribonucleotide and the 5' terminal nucleotide or 2, 3, 4, 5, 6, 7, 8, 9, 10, 11, 12, 13 or 14 consecutive nucleotides at the 5' terminus of (N')y are deoxyribonucleotides. In further embodiments the 5' terminal nucleotide or 2, 3, 4, 5, 6, 7, 8, or 9 consecutive nucleotides at the 5' terminus and 1, 2, 3, 4, 5, or 6 consecutive nucleotides at the 3' termini of (N)x are deoxyribonucleotides and each of N' is an unmodified ribonucleotide. In yet further embodiments (N)x comprises unmodified ribonucleotides and 1 or 2, 3 or 4 consecutive deoxyribonucleotides independently at each of the 5' and 3' termini and 1 or 2, 3, 4, 5 or 6 consecutive deoxyribonucleotides in internal positions; and each of N' is an unmodified ribonucleotide. In certain embodiments the 3' terminal nucleotide or 2, 3, 4, 5, 6, 7, 8, 9, 10, 11, 12 13 or 14 consecutive nucleotides at the 3' terminus of (N')y and the terminal 5' nucleotide or 2, 3, 4, 5, 6, 7, 8, 9, 10, 11, 12 13 or 14 consecutive nucleotides at the 5' terminus of (N)x are deoxyribonucleotides. The present invention excludes compounds in which each of N and/or N' is a deoxyribonucleotide. In some embodiments the 5' terminal nucleotide of N or 2 or 3 consecutive of N and 1,2, or 3 of N' is a deoxyribonucleotide. Certain examples of active DNA/RNA siRNA chimeras are disclosed in US patent publication 2005/0004064, and Ui-Tei, 2008 (NAR 36(7):2136-2151) incorporated herein by reference in their entirety.

Unless otherwise indicated, in preferred embodiments of the structures discussed herein the covalent bond between each consecutive N or N' is a phosphodiester bond.

An additional novel molecule provided by the present invention is an oligonucleotide comprising consecutive nucleotides wherein a first segment of such nucleotides encode a first inhibitory RNA molecule, a second segment of such nucleotides encode a second inhibitory RNA molecule, and a third segment of such nucleotides encode a third inhibitory RNA molecule. Each of the first, the second and the third segment may comprise one strand of a double stranded RNA and the first, second and third segments may be joined together by a linker. Further, the oligonucleotide may comprise three double stranded segments joined together by one or more linker.

Thus, one molecule provided by the present invention is an oligonucleotide comprising consecutive nucleotides which encode three inhibitory RNA molecules; said oligonucleotide may possess a triple stranded structure, such that three double stranded arms are linked together by one or more linker, such as any of the linkers presented hereinabove. This molecule forms a "star"-like structure, and may also be referred to herein as RNAstar. Such structures are disclosed in PCT patent publication WO 2007/091269, assigned to the assignee of the present invention and incorporated herein in its entirety by reference.

A covalent bond refers to an internucleotide linkage linking one nucleotide monomer to an adjacent nucleotide monomer. A covalent bond includes for example, a phosphodiester bond, a phosphorothioate bond, a P-alkoxy bond, a P-carboxy bond and the like. The normal internucleoside linkage of RNA and DNA is a 3' to 5' phosphodiester linkage. In certain preferred embodiments a covalent bond is a phosphodiester bond. Covalent bond encompasses non-phosphorous-containing internucleoside linkages, such as those disclosed in WO 2004/041924 inter alia. Unless otherwise indicated, in preferred embodiments of the structures discussed herein the covalent bond between each consecutive N or N' is a phosphodiester bond.

For all of the structures above, in some embodiments the oligonucleotide sequence of (N)x is fully complementary to the oligonucleotide sequence of (N')y. In other embodiments (N)x and (N')y are substantially complementary. In certain embodiments (N)x is fully complementary to a target sequence. In other embodiments (N)x is substantially complementary to a target sequence.

In some embodiments, neither (N)x nor (N')y are phosphorylated at the 3' and 5' termini. In other embodiments either or both (N)x and (N')y are phosphorylated at the 3' termini (3' Pi). In yet another embodiment, either or both (N)x and (N')y are phosphorylated at the 3' termini with non-cleavable phosphate groups. In yet another embodiment, either or both (N)x and (N')y are phosphorylated at the terminal 2' termini position using cleavable or non-cleavable phosphate groups. Further, the inhibitory nucleic acid molecules of the present invention may comprise one or more gaps and/or one or more nicks and/or one or more mismatches. Without wishing to be bound by theory, gaps, nicks and mismatches have the advantage of partially destabilizing the nucleic acid/siRNA, so that it may be more easily processed by endogenous cellular machinery such as DICER, DROSHA or RISC into its inhibitory components.

In the context of the present invention, a gap in a nucleic acid refers to the absence of one or more internal nucleotides in one strand, while a nick in a nucleic acid refers to the absence of an internucleotide linkage between two adjacent nucleotides in one strand. Any of the molecules of the present invention may contain one or more gaps and/or one or more nicks.

In one aspect the present invention provides a compound having Structure (I) set forth below:

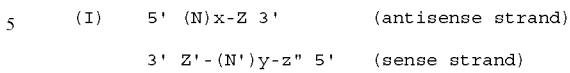

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent, but if present is a capping moiety covalently attached at the 5' terminus of (N') y;
wherein x=18 to 27;
wherein y=18 to 27;
wherein (N)x comprises modified and unmodified ribonucleotides, each modified ribonucleotide having a 2'-O-methyl on its sugar, wherein N at the 3' terminus of (N)x is a modified ribonucleotide, (N)x comprises at least five alternating modified ribonucleotides beginning at the 3' end and at least nine modified ribonucleotides in total and each remaining N is an unmodified ribonucleotide;
wherein in (N')y at least one unconventional moiety is present, which unconventional moiety may be an abasic ribose moiety, an abasic deoxyribose moiety, a modified or unmodified deoxyribonucleotide, a mirror nucleotide, and a nucleotide joined to an adjacent nucleotide by a 2'-5' internucleotide phosphate bond; and
wherein the sequence of (N)x is substantially complementary to the sequence of (N')y; and the sequence of (N')y is substantially identical to the sequence of an mRNA encoded by the RTP801L gene.

In some embodiments x=y=19. In other embodiments x=y=23. In some embodiments the at least one unconventional moiety is present at positions 15, 16, 17, or 18 in (N')y. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18.

In other embodiments the unconventional moiety is an abasic moiety. In various embodiments (N')y comprises at least five abasic ribose moieties or abasic deoxyribose moieties.

In yet other embodiments (N')y comprises at least five abasic ribose moieties or abasic deoxyribose moieties and at least one of N' is an LNA.

In some embodiments of Structure (IX) (N)x comprises nine alternating modified ribonucleotides. In other embodiments of Structure (I) (N)x comprises nine alternating modified ribonucleotides further comprising a 2'O modified nucleotide at position 2. In some embodiments (N)x comprises 2'O Me modified ribonucleotides at the odd numbered positions 1, 3, 5, 7, 9, 11, 13, 15, 17, 19. In other embodiments (N)x further comprises a 2'O Me modified ribonucleotide at one or both of positions 2 and 18. In yet other embodiments (N)x comprises 2'O Me modified ribonucleotides at positions 2, 4, 6, 8, 11, 13, 15, 17, 19.

In various embodiments z" is present and is selected from an abasic ribose moiety, a deoxyribose moiety; an inverted abasic ribose moiety, a deoxyribose moiety; C6-amino-Pi; a mirror nucleotide.

In another aspect the present invention provides a compound having Structure (J) set forth below:

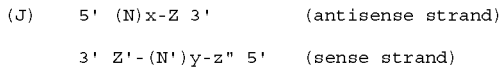

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent but if present is a capping moiety covalently attached at the 5' terminus of (N')y;
wherein x=18 to 27;
wherein y=18 to 27;
wherein (N)x comprises modified or unmodified ribonucleotides, and optionally at least one unconventional moiety;
wherein in (N')y at least one unconventional moiety is present, which unconventional moiety may be an abasic ribose moiety, an abasic deoxyribose moiety, a modified or unmodified deoxyribonucleotide, a mirror nucleotide, a non-base pairing nucleotide analog or a nucleotide joined to an adjacent nucleotide by a 2'-5' internucleotide phosphate bond; and
wherein the sequence of (N)x is substantially complementary to the sequence of (N')y; and the sequence of (N')y is substantially identical to the sequence of an mRNA encoded by the RTP801L gene.

In some embodiments x=y=19. In other embodiments x=y=23. In some preferred embodiments (N)x comprises modified and unmodified ribonucleotides, and at least one unconventional moiety.

In some embodiments in (N)x the N at the 3' terminus is a modified ribonucleotide and (N)x comprises at least 8 modified ribonucleotides. In other embodiments at least 5 of the at least 8 modified ribonucleotides are alternating beginning at the 3' end. In some embodiments (N)x comprises an abasic moiety in one of positions 5, 6, 7, 8, 9, 10, 11, 12, 13, 14 or 15.

In some embodiments the at least one unconventional moiety in (N')y is present at positions 15, 16, 17, or 18. In some embodiments the unconventional moiety is selected from a mirror nucleotide, an abasic ribose moiety and an abasic deoxyribose moiety. In some preferred embodiments the unconventional moiety is a mirror nucleotide, preferably an L-DNA moiety. In some embodiments an L-DNA moiety is present at position 17, position 18 or positions 17 and 18. In other embodiments the at least one unconventional moiety in (N')y is an abasic ribose moiety or an abasic deoxyribose moiety.

In various embodiments of Structure (X) z" is present and is selected from an abasic ribose moiety, a deoxyribose moiety; an inverted abasic ribose moiety, a deoxyribose moiety; C6-amino-Pi; a mirror nucleotide.

In yet another aspect the present invention provides a compound having Structure (K) set forth below:

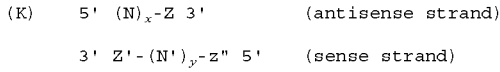

wherein each of N and N' is a ribonucleotide which may be unmodified or modified, or an unconventional moiety;
wherein each of (N)x and (N')y is an oligonucleotide in which each consecutive N or N' is joined to the next N or N' by a covalent bond;
wherein Z and Z' may be present or absent, but if present is independently 1-5 consecutive nucleotides covalently attached at the 3' terminus of the strand in which it is present;
wherein z" may be present or absent but if present is a capping moiety covalently attached at the 5' terminus of (N')y;
wherein x=18 to 27;
wherein y=18 to 27;
wherein (N)x comprises a combination of modified or unmodified ribonucleotides and unconventional moieties, any modified ribonucleotide having a 2'-O-methyl on its sugar;
wherein (N')y comprises modified or unmodified ribonucleotides and optionally an unconventional moiety, any modified ribonucleotide having a 2'OMe on its sugar;
wherein the sequence of (N)x is substantially complementary to the sequence of (N')y; and the sequence of (N')y is substantially identical to the sequence of an mRNA encoded by the RTP801L gene; and wherein there are less than 15 consecutive nucleotides complementary to the mRNA.

In some embodiments x=y=19. In other embodiments x=y=23. In some preferred embodiments the at least one preferred one unconventional moiety is present in (N)x and is an abasic ribose moiety or an abasic deoxyribose moiety. In other embodiments the at least one unconventional moiety is present in (N)x and is a non-base pairing nucleotide analog. In various embodiments (N')y comprises unmodified ribonucleotides. In some embodiments (N)x comprises at least five abasic ribose moieties or abasic deoxyribose moieties or a combination thereof. In certain embodiments (N)x and/or (N')y comprise modified ribonucleotides which do not base pair with corresponding modified or unmodified ribonucleotides in (N')y and/or (N)x.

In various embodiments the present invention provides an siRNA set forth in Structure (L):

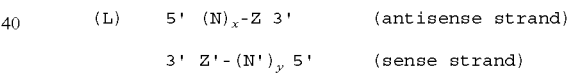

wherein each of N and N' is a nucleotide selected from an unmodified ribonucleotide, a modified ribonucleotide, an unmodified deoxyribonucleotide and a modified deoxyribonucleotide;
wherein each of (N)$_x$ and (N')$_y$ is an oligonucleotide in which each consecutive N or N' is joined to the next N or N' by a covalent bond;
wherein Z and Z' are absent;
wherein x=y=19;
wherein in (N')y the nucleotide in at least one of positions 15, 16, 17, 18 and 19 comprises a nucleotide selected from an abasic pseudo-nucleotide, a mirror nucleotide, a deoxyribonucleotide and a nucleotide joined to an adjacent nucleotide by a 2'-5' internucleotide bond;
wherein (N)x comprises alternating modified ribonucleotides and unmodified ribonucleotides each modified ribonucleotide being modified so as to have a 2'-O-methyl on its sugar and the ribonucleotide located at the middle position of (N)x being modified or unmodified, preferably unmodified; and
wherein the sequence of (N)x is substantially complementary to the sequence of (N')y; and the sequence of (N')y is substantially identical to the mRNA of the RTP801L gene.

In some embodiments of Structure (L), in (N')y the nucleotide in one or both of positions 17 and 18 comprises a modified nucleotide selected from an abasic pseudo-nucleotide, a mirror nucleotide and a nucleotide joined to an adjacent nucleotide by a 2'-5' internucleotide bond. In some embodiments the mirror nucleotide is selected from L-DNA and L-RNA. In various embodiments the mirror nucleotide is L-DNA.

In various embodiments (N')y comprises a modified nucleotide at position 15 wherein the modified nucleotide is selected from a mirror nucleotide and a deoxyribonucleotide.

In certain embodiments (N')y further comprises a modified nucleotide or pseudo nucleotide at position 2 wherein the pseudo nucleotide may be an abasic pseudo-nucleotide analog and the modified nucleotide is optionally a mirror nucleotide.

In various embodiments the antisense strand (N)x comprises 2'O-Me modified ribonucleotides at the odd numbered positions (5' to 3'; positions 1, 3, 5, 7, 9, 11, 13, 15, 17, 19). In some embodiments (N)x further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

Other embodiments of Structures (L), (I) and (J) are envisaged wherein x=y=21 or wherein x=y=23; in these embodiments the modifications for (N')y discussed above instead of being in positions 17 and 18 are in positions 19 and 20 for 21-mer oligonucleotide and 21 and 22 for 23 mer oligonucleotide; similarly the modifications in positions 15, 16, 17, 18 or 19 are in positions 17, 18, 19, 20 or 21 for the 21-mer oligonucleotide and positions 19, 20, 21, 22, or 23 for the 23-mer oligonucleotide. The 2'O Me modifications on the antisense strand are similarly adjusted. In some embodiments (N)x comprises 2'O Me modified ribonucleotides at the odd numbered positions (5' to 3'; positions 1, 3, 5, 7, 9, 12, 14, 16, 18, 20 for the 21 mer oligonucleotide [nucleotide at position 11 unmodified] and 1, 3, 5, 7, 9, 11, 13, 15, 17, 19, 21, 23 for the 23 mer oligonucleotide [nucleotide at position 12 unmodified]. In other embodiments (N)x comprises 2'O Me modified ribonucleotides at positions 2, 4, 6, 8, 10, 12, 14, 16, 18, 20 [nucleotide at position 11 unmodified for the 21 mer oligonucleotide and at positions 2, 4, 6, 8, 10, 13, 15, 17, 19, 21, 23 for the 23 mer oligonucleotide [nucleotide at position 12 unmodified].

In some embodiments (N')y further comprises a 5' terminal cap nucleotide. In various embodiments the terminal cap moiety is selected from an abasic pseudo-nucleotide analog, an inverted abasic pseudo-nucleotide analog, an L-DNA nucleotide, and a C6-imine phosphate (C6 amino linker with phosphate at terminus).

In other embodiments the present invention provides a compound having Structure (M) set forth below:

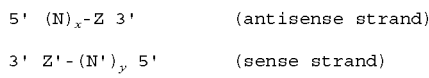

wherein each of N and N' is selected from a pseudo-nucleotide and a nucleotide;
wherein each nucleotide is selected from an unmodified ribonucleotide, a modified ribonucleotide, an unmodified deoxyribonucleotide and a modified deoxyribonucleotide;
wherein each of (N)x and (N')y is an oligonucleotide in which each consecutive N or N' is joined to the next N or N' by a covalent bond;
wherein Z and Z' are absent;
wherein x=18 to 27;
wherein y=18 to 27;
wherein the sequence of (N)x is substantially complementary to the sequence of (N')y; and the sequence of (N')y is substantially identical to an mRNA of the RTP801L gene;
wherein at least one of N is selected from an abasic pseudo nucleotide, a non-pairing nucleotide analog and a nucleotide mismatch to the mRNA of the RTP801L gene in a position of (N)x such that (N)x comprises less than 15 consecutive nucleotides complementary to the mRNA of the RTP801L gene.

In other embodiments the present invention provides a double stranded compound having Structure (N) set forth below:

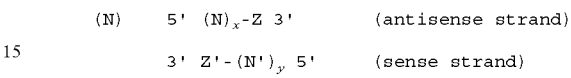

wherein each of N and N' is a nucleotide selected from an unmodified ribonucleotide, a modified ribonucleotide, an unmodified deoxyribonucleotide and a modified deoxyribonucleotide;
wherein each of (N)x and (N')y is an oligonucleotide in which each consecutive N or N' is joined to the next N or N' by a covalent bond;
wherein Z and Z' are absent;
wherein each of x and y is an integer between 18 and 40;
wherein the sequence of (N)x is substantially complementary to the sequence of (N')y; and the sequence of (N')y is substantially identical to an mRNA of the RTP801L gene;
wherein (N)x, (N')y or (N)x and (N')y comprise non base-pairing modified nucleotides such that (N)x and (N')y form less than 15 base pairs in the double stranded compound.

In other embodiments the present invention provides a compound having Structure (O) set forth below:

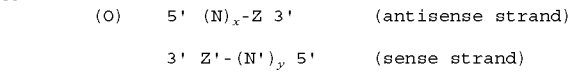

wherein each of N is a nucleotide selected from an unmodified ribonucleotide, a modified ribonucleotide, an unmodified deoxyribonucleotide and a modified deoxyribonucleotide;
wherein each of N' is a nucleotide analog selected from a six membered sugar nucleotide, seven membered sugar nucleotide, morpholino moiety, peptide nucleic acid and combinations thereof;
wherein each of (N)x and (N')y is an oligonucleotide in which each consecutive N or N' is joined to the next N or N' by a covalent bond;
wherein Z and Z" are absent;
wherein each of x and y is an integer between 18 and 40;
wherein the sequence of (N)x is substantially complementary to the sequence of (N')y; and the sequence of (N')y is substantially identical to an mRNA of the RTP801L gene.

In other embodiments the present invention provides a compound having Structure (P) set forth below:

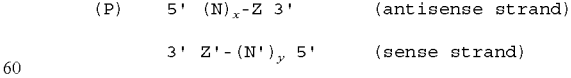

wherein each of N and N' is a nucleotide selected from an unmodified ribonucleotide, a modified ribonucleotide, an unmodified deoxyribonucleotide and a modified deoxyribonucleotide;
wherein each of (N)x and (N')y is an oligonucleotide in which each consecutive N or N' is joined to the next N or N' by a covalent bond;

wherein Z and Z' are absent;
wherein each of x and y is an integer between 18 and 40;
wherein one of N or N' in an internal position of (N)x or (N')y or one or more of N or N' at a terminal position of (N)x or (N')y comprises an abasic moiety or a 2' modified nucleotide; wherein the sequence of (N)x is substantially complementary to the sequence of (N')y; and the sequence of (N')y is substantially identical to an mRNA of the RTP801L gene.

In various embodiments (N')y comprises a modified nucleotide at position 15 wherein the modified nucleotide is selected from a mirror nucleotide and a deoxyribonucleotide.

In certain embodiments (N')y further comprises a modified nucleotide at position 2 wherein the modified nucleotide is selected from a mirror nucleotide and an abasic pseudonucleotide analog.

In various embodiments the antisense strand (N)x comprises 2'O-Me modified ribonucleotides at the odd numbered positions (5' to 3'; positions 1, 3, 5, 7, 9, 11, 13, 15, 17, 19), In some embodiments $(N)_x$ further comprises 2'O-Me modified ribonucleotides at one or both positions 2 and 18. In other embodiments (N)x comprises 2'O Me modified ribonucleotides at positions 2, 4, 6, 8, 11, 13, 15, 17, 19.

The Structural motifs described above are useful with any oligonucleotide pair (sense and antisense strands) to a mammalian RTP801L gene, and preferably to the human RTP801L gene.

Any siRNA sequence disclosed herein can be prepared having any of the modifications/structures disclosed herein.

In another aspect the present invention provides a pharmaceutical composition comprising a modified or unmodified compound of the present invention, in an amount effective to inhibit human RTP801L gene expression wherein the compound comprises an antisense sequence, $(N)_x$; and a pharmaceutically acceptable carrier.

In yet another aspect the present invention provides a pharmaceutical composition comprising one or more modified compounds of the present invention, in an amount effective to inhibit human RTP801L gene expression wherein the compound comprises an antisense sequence, $(N)_x$; and a pharmaceutically acceptable carrier.

In another aspect, the present invention relates to a method for the treatment of a subject in need of treatment for a disease or disorder or symptoms associated with the disease or disorder, associated with the expression of the RTP801L gene comprising administering to the subject an amount of an siRNA, according to the present invention, in a therapeutically effective dose so as to thereby treat the subject.

The methods of the invention comprise administering to the subject one or more siRNA compounds which inhibit expression of the RTP801L gene. The novel structures disclosed herein, when integrated into antisense and corresponding sense nucleic acid sequences, provide siRNA compounds useful in reducing expression of the RTP801L gene.

Pharmaceutical Compositions

The present invention provides a pharmaceutical composition comprising one or more of the compounds of the invention; and a pharmaceutically acceptable carrier. Such compositions may comprise a mixture of two or more different oligonucleotides/siRNAs.

The invention further provides a pharmaceutical composition comprising at least one compound of the invention covalently or non-covalently bound to one or more compounds of the invention in an amount effective to inhibit RTP801L; and a pharmaceutically acceptable carrier. Endogenous cellular complexes to produce one or more oligoribonucleotides of the invention may process the compound intracellularly.

The present invention also provides for a process of preparing a pharmaceutical composition, which comprises:
providing one or more siRNA compounds of the invention; and
admixing said compound with a pharmaceutically acceptable carrier.

Substantially complementary refers to complementarity of greater than about 84%, to another sequence. For example in a duplex region consisting of 19 base pairs one mismatch results in 94.7% complementarity, two mismatches results in about 89.5% complementarity and 3 mismatches results in about 84.2% complementarity, rendering the duplex region substantially complementary. Accordingly substantially identical refers to identity of greater than about 84%, to another sequence.

Additionally, the invention provides a method of inhibiting the expression of the genes of the present invention by at least 50% as compared to a control comprising contacting an mRNA transcript of the gene of the present invention with one or more of the compounds of the invention.

In one embodiment the oligoribonucleotide is inhibiting the RTP801L gene, whereby the inhibition is selected from the group comprising inhibition of gene function, inhibition of polypeptide and inhibition of mRNA expression.

In one embodiment the compound is inhibiting expression of a polypeptide, whereby the inhibition is selected from the group comprising inhibition of function (which may be examined by an enzymatic assay or a binding assay with a known interactor of the native gene/polypeptide, inter alia), inhibition of protein (which may be examined by Western blotting, ELISA or immuno-precipitation, inter alia) and inhibition of mRNA expression (which may be examined by Northern blotting, quantitative RT-PCR, in-situ hybridisation or microarray hybridisation, inter alia).

In additional embodiments the invention provides a method of treating a subject suffering from a disease accompanied by an elevated level of the RTP801L gene/polypeptide, the method comprising administering to the subject a compound of the invention in a therapeutically effective dose thereby treating the subject.

More particularly, the invention provides a chemically modified double stranded oligoribonucleotide wherein one strand comprises consecutive nucleotides having, from 5' to 3', the sequence set forth in any one of Tables A-G or a homolog thereof wherein in up to two of the ribonucleotides in each terminal region is altered.

Additionally, further nucleic acids according to the present invention comprise at least 14 contiguous nucleotides of any one of the oligomers set forth in any one of Tables A-G and more preferably 14 contiguous nucleotide base pairs at any end of the double-stranded structure comprised of the first strand and second strand as described above.

Delivery

The siRNA molecules of the present invention may be delivered to the target tissue by direct application of the naked molecules prepared with a carrier or a diluent.

The term "naked siRNA" refers to siRNA molecules that are free from any delivery vehicle that acts to assist, promote or facilitate entry into the cell, including viral sequences, viral particles, liposome formulations, lipofectin or precipitating agents and the like. For example, siRNA in PBS is "naked siRNA".

However, in some embodiments the siRNA molecules of the invention are delivered in liposome formulations and lipofectin formulations and the like and can be prepared by methods well known to those skilled in the art. Such methods are described, for example, in U.S. Pat. Nos. 5,593,972, 5,589,466, and 5,580,859, which are herein incorporated by reference.

Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003. 327: 761-766; Lewis et al., Nat. Gen. 2002, 32: 107-108 and Simeoni et al., *NAR* 2003, 31, 11:2717-2724).

The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention and they include liposomes and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art. In one specific embodiment of this invention topical and transdermal formulations may be selected. The siRNAs or pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners.

The "therapeutically effective dose" for purposes herein is thus determined by such considerations as are known in the art. The dose must be effective to achieve improvement including but not limited to improved survival rate or more rapid recovery, or improvement or elimination of symptoms and other indicators as are selected as appropriate measures by those skilled in the art.

In general, the active dose of compound for humans is in the range of from 1 ng/kg to about 20-100 mg/kg body weight per day, preferably about 0.01 mg to about 2-10 mg/kg body weight per day, in a regimen of one dose per day or twice or three or more times per day for a period of 1-4 weeks or longer.

The compounds of the present invention can be administered by any of the conventional routes of administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds can be administered orally, subcutaneously or parenterally including intravenous, intraarterial, intramuscular, intraperitoneally, and intranasal, inhalation, transtympanic administration as well as intrathecal and infusion techniques. Implants of the compounds are also useful. Liquid forms may be prepared for injection, the term including subcutaneous, transdermal, intravenous, intramuscular, intrathecal, and other parental routes of administration. The liquid compositions include aqueous solutions, with and without organic co-solvents, aqueous or oil suspensions, emulsions with edible oils, as well as similar pharmaceutical vehicles. In a particular embodiment, the administration comprises intravenous administration. In another embodiment the administration comprises topical or local administration.

In addition, in certain embodiments the compositions for use in the novel treatments of the present invention may be formed as aerosols, for example for intranasal administration.

In certain embodiments, oral compositions (such as tablets, suspensions, solutions) may be effective for local delivery to the oral cavity such as oral composition suitable for mouthwash for the treatment of oral mucositis.

The compounds of the present invention can be administered topically to the surface of the eye. It should be noted that the compound is preferably administered as the compound or as pharmaceutically acceptable salt active ingredient in combination with pharmaceutically acceptable carriers, solvents, diluents, excipients, adjuvants and or vehicles. According to the present invention the preferred method of delivery is topical administration for topical delivery to the eye.

Liquid forms are prepared for drops or spray. The liquid compositions include aqueous solutions, with and without organic co-solvents, aqueous or oil suspensions, emulsions with oils, as well as similar pharmaceutical vehicles. In some embodiments administration comprises topical or local administration.

These compounds are administered to humans and other animals for therapy by any suitable route of administration to the eye, as by, for example, a spray or drops, and topically, as by ointments, suspensions or drops.

In preferred embodiments the subject being treated is a warm-blooded animal and, in particular, mammals including human.

Methods of Treatment

In one aspect, the present invention relates to a method for the treatment of a subject in need of treatment for a disease or disorder associated with expression of the RTP801L gene, comprising administering to the subject an amount of at least one chemically modified siRNA which inhibits expression of RTP801L. In certain preferred embodiments more than one siRNA compound is administered.

In preferred embodiments the subject being treated is a warm-blooded animal and, in particular, mammals including human.

The methods of the invention comprise administering to the subject one or more RTP801L siRNA compounds which down-regulate expression of the RTP801L gene; and in particular east one siRNA in a therapeutically effective dose so as to thereby treat the subject.

The term "treatment" refers to both therapeutic treatment and prophylactic or preventative measures, wherein the object is to prevent or slow down, attenuate the related disorder as listed above. Those in need of treatment include those already experiencing the disease or condition, those prone to having the disease or condition, and those in which the disease or condition is to be prevented. The compounds of the invention may be administered before, during or subsequent to the onset of the disease or condition or symptoms associated therewith. In cases where treatment is for the purpose of prevention, then the present invention relates to a method for delaying the onset of or averting the development of the disease or disorder.

In general, the method includes administering oligoribonucleotides, such as small interfering RNAs (i.e., siRNAs) that are targeted to a particular mRNA and hybridize to it, or nucleic acid material that can produce siRNAs in a cell, in an amount sufficient to down-regulate expression of a target gene by an RNA interference mechanism. In particular, the subject method can be used to inhibit expression of the RTP801L gene for treatment of respiratory disorders, microvascular disorders, eye disorders and hearing impairments.

Thus, in one embodiment the present invention provides for a method of treating a patient suffering from a microvascular disorder, an eye disease a respiratory disorder, a hearing disorder or a spinal cord injury or other wound, comprising administering to the patient a pharmaceutical composition comprising an RTP801L inhibitor in a therapeutically effective amount so as to thereby treat the patient. The invention further provides a method of treating a patient suffering from a microvascular disorder, an eye disease, a respiratory disorder, a hearing disorder or a spinal cord injury or other wound, or an ischemic disease, comprising administering to the patient a pharmaceutical composition comprising an RTP801L inhibitor, in a dosage and over a period of time sufficient to promote recovery. The eye disease may be macular degeneration such as age-related macular degeneration (AMD), or glaucoma, inter alia. The microvascular disorder may be diabetic retinopathy or acute renal failure, inter alia. The respiratory disorder may be chronic obstructive pulmonary disease (COPD), acute lung injury (ALI), Acute Respiratory Distress Syndrome (ARDS), Lung transplantation, emphysema, chronic bronchitis, asthma and lung cancer, inter alia. The hearing disorder may be trauma-induced deafness, age-related deafness or cisplatin-induced deafness, inter alia. Thus, a list of conditions to be treated includes ARF, hearing loss, Acute Respiratory Distress Syndrome, Glaucoma, AMD, COPD, nephrotoxicity, lung transplantation, and Ischemia/reperfusion injury. Oligonucleotide sequences of RTP801L siRNA inhibitors are set forth below and in any one of Tables A-G (SEQ ID NOs:2-6927).

The present invention further relates to the use of any of the compounds disclosed herein, particularly to novel small interfering RNAs (siRNAs), in the treatment of diseases and disorders associated with RTP801L expression.

A further end modification is a biotin group. Such biotin group may preferably be attached to either the most 5' or the most 3' nucleotide of the first and/or second strand or to both ends. In a more preferred embodiment the biotin group is coupled to a polypeptide or a protein. It is also within the scope of the present invention that the polypeptide or protein is attached through any of the other aforementioned end modifications.

The various end modifications as disclosed herein are preferably located at the ribose moiety of a nucleotide of the nucleic acid according to the present invention. More particularly, the end modification may be attached to or replace any of the OH-groups of the ribose moiety, including but not limited to the 2'OH, 3'OH and 5'OH position, provided that the nucleotide thus modified is a terminal nucleotide. Inverted abasic or abasic are nucleotides, either deoxyribonucleotides or ribonucleotides which do not have a nucleobase moiety. This kind of compound is, inter alia, described in Sternberger, M., et al., (2002. *Antisense Nucleic Acid Drug Dev,* 12, 131-43).

A further form of nucleotides used may be siNA which is, among others, described in international patent application WO 03/070918.

It is to be understood that, in the context of the present invention, any of the siRNA molecules disclosed herein, or any long double-stranded RNA molecules (typically 25-500 nucleotides in length) which are processed by endogenous cellular complexes (such as DICER—see above) to form the siRNA molecules disclosed herein, or molecules which comprise the siRNA molecules disclosed herein, can be incorporated into the molecules of the present invention to form additional novel molecules, and can employed in the treatment of the diseases or disorders described herein.

In particular, it is envisaged that a long oligonucleotide (typically about 80-500 nucleotides in length) comprising one or more stem and loop structures, where stem regions comprise the oligonucleotides of the invention, may be delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence. Any molecules, such as, for example, antisense DNA molecules which comprise the inhibitory sequences disclosed herein (with the appropriate nucleic acid modifications) are particularly desirable and may be used in the same capacity as their corresponding RNAs/siRNAs for all uses and methods disclosed herein.

In addition, analogs of polynucleotides can be prepared wherein the structure of the nucleotide is fundamentally altered and that are better suited as therapeutic or experimental reagents. An example of a nucleotide analog is a peptide nucleic acid (PNA) wherein the deoxyribose (or ribose) phosphate backbone in DNA (or RNA is replaced with a polyamide backbone which is similar to that found in peptides. PNA analogs have been shown to be resistant to degradation by enzymes and to extend lives in vivo and in vitro. Further, PNAs have been shown to bind stronger to a complementary DNA sequence than a DNA molecule. This observation is attributed to the lack of charge repulsion between the PNA strand and the DNA strand. Other modifications that can be made to oligonucleotides include polymer backbones, cyclic backbones, or acyclic backbones.

In a particularly preferred embodiment the compounds of the present invention possess a sequence present in Table F (SEQ ID NOS: 6896-6927). In other preferred embodiments the RTP801L compound is selected from any one of the compounds set forth in Table G.

In one preferred embodiment the siRNA used in the methods of the present invention is one of a pair of oligonucleotides set forth in Table F. In another preferred embodiment the siRNA compound is selected from a compound set forth in Table G.

Thus, in a particularly preferred embodiment, the present invention comprises a compound having an oligonucleotide sequence and chemical modifications as shown in FIG. 8. In some preferred embodiments the compound is ID 128339 x=y=19; wherein (N)x comprises alternating unmodified and 2'OMe sugar modified ribonucleotides and wherein (N')y comprises unmodified ribonucleotides and an L-deoxyribonucleotide at position 18 and an optional deoxyribonucleotide at position 15. siRNA compound 128339 exhibits good activity (knockdown of about 75% at 20 nM) in human cells and stability in human serum.

And a compound having the structure

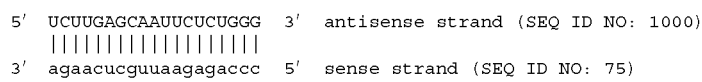

wherein in (N)x the ribonucleotides alternate between modified ribonucleotides and unmodified ribonucleotides each modified ribonucleotide being modified so as to have a 2'-O-methyl on its sugar and the ribonucleotide located at the middle position being unmodified;

wherein in (N')y the nucleotide at position 18 or 17 and 18 is a mirror nucleotide and the nucleotide at position 15 is optionally an unmodified ribonucleotide or a deoxyribonucleotide; and wherein the antisense and the sense strands are unphosphorylated or phosphorylated at the 3' termini.

And a compound having the structure

```
5'  AUCUUGAGCAAUUCUCUGG  3'  antisense strand (SEQ ID NO: 999)
    |||||||||||||||||||
3'  UAGAACUCGUUAAGAGACC  5'  sense strand (SEQ ID NO: 74)
``` wherein in (N)x the ribonucleotides alternate between modified ribonucleotides and unmodified ribonucleotides each modified ribonucleotide being modified so as to have a 2'-O-methyl on its sugar and the ribonucleotide located at the middle position being unmodified;

wherein in (N')y the nucleotide at position 18 or 17 and 18 is a mirror nucleotide and the nucleotide at position 15 is optionally an unmodified ribonucleotide or a deoxyribonucleotide; and wherein the antisense and the sense strands are unphosphorylated or phosphorylated at the 3' termini.

And a compound having the structure

```
5'  UCAAUUUCCAAGUUCACGU  3'  antisense strand (SEQ ID NO: 6914)
    |||||||||||||||||||
3'  AGUUAAAGGUUCAAGUGCA  5'  sense strand (SEQ ID NO: 6898)
``` wherein in (N)x the ribonucleotides alternate between modified ribonucleotides and unmodified ribonucleotides each modified ribonucleotide being modified so as to have a 2'-O-methyl on its sugar and the ribonucleotide located at the middle position being unmodified;

wherein in (N')y the nucleotide at position 18 or 17 and 18 is a mirror nucleotide and the nucleotide at position 15 is optionally an unmodified ribonucleotide or a deoxyribonucleotide; and wherein the antisense and the sense strands are unphosphorylated or phosphorylated at the 3' termini.

And a compound having the structure

```
5'  UUGGACAGACAGUUCUCCA  3'  antisense strand (SEQ ID NO: 6915)
    |||||||||||||||||||
3'  AACCUGUCUGUCAAGAGGU  5'  sense strand (SEQ ID NO: 6899)
``` wherein in (N)x the ribonucleotides alternate between modified ribonucleotides and unmodified ribonucleotides each modified ribonucleotide being modified so as to have a 2'-O-methyl on its sugar and the ribonucleotide located at the middle position being unmodified;

wherein in (N')y the nucleotide at position 18 or 17 and 18 is a mirror nucleotide and the nucleotide at position 15 is optionally an unmodified ribonucleotide or a deoxyribonucleotide; and wherein the antisense and the sense strands are unphosphorylated or phosphorylated at the 3' termini.

Further, the present invention provides for a pharmaceutical composition comprising any one of the above compounds and a pharmaceutically acceptable excipient.

The siRNA molecules having antisense strand SEQ ID NO:999 and sense strand SEQ ID NO:74 or antisense strand SEQ ID NO:1000 and sense strand SEQ ID NO:75 or antisense strand SEQ ID NO:6914 and sense strand SEQ ID NO:6898 or antisense strand SEQ ID NO:6915 and sense strand SEQ ID NO:6899 comprise any of the additional modifications disclosed herein, and are used in the treatment of any of the indications disclosed herein, such as the following diseases or conditions: hearing loss, acute renal failure (ARF), glaucoma, acute respiratory distress syndrome (ARDS) and other acute lung and respiratory injuries, ischemia-reperfusion injury following lung transplantation, organ transplantation including lung, liver, heart, bone marrow, pancreas, cornea and kidney transplantation, spinal cord injury, pressure sores, age-related macular degeneration (AMD), dry eye syndrome, oral mucositis and chronic obstructive pulmonary disease (COPD). Other indications include cancer of all types, chemical-induced nephrotoxicity and chemical-induced neurotoxicity, for example toxicity induced by cisplatin and cisplatin-like compounds, by aminoglycosides, by loop diuretics, and by hydroquinone and their analogs.

These compounds and pharmaceuticals are used to treat a patient suffering from any one of the diseases or conditions disclosed herein; further, any of the siRNAs in any one of Tables A-G are used in the same marnier.

Additionally, the invention provides a method of down-regulating the expression of the RTP801L gene by at least 50% as compared to a control comprising contacting an mRNA transcript of the RTP801L gene with one or more of the compounds of the invention.

In one embodiment the oligoribonucleotide is down-regulating the RTP801L gene, whereby the down-regulation is selected from the group comprising down-regulation of gene function, down-regulation of polypeptide and down-regulation of mRNA expression.

In one embodiment the compound is down-regulating the RTP801L polypeptide, whereby the down-regulation is selected from the group comprising down-regulation of function (which may be examined by an enzymatic assay or a binding assay with a known interactor of the native gene/polypeptide, inter alia), down-regulation of protein (which may be examined by Western blotting, ELISA or immunoprecipitation, inter alia) and down-regulation of mRNA expression (which may be examined by Northern blotting, quantitative RT-PCR, in-situ hybridization or microarray hybridisation, inter alia).

In additional embodiments the invention provides a method of treating a patient suffering from a disease accompanied by an elevated level of RTP801L, the method comprising administering to the patient a compound of the invention in a therapeutically effective dose thereby treating the patient.

More particularly, the invention provides an oligoribonucleotide wherein one strand comprises consecutive nucleotides having, from 5' to 3', the sequence set forth in any one of Tables A-G, or a homolog thereof wherein in up to two of the ribonucleotides in each terminal region is altered.

The terminal region of the oligoribonucleotide refers to bases 1-4 and/or 16-19 in the 19-mer sequence and to bases 1-4 and/or 18-21 in the 21-mer sequence, and to bases 1-4 and/or 20-23 in the 23 mer sequence.

When the nucleic acid according to the present invention is manufactured or expressed, preferably expressed in vivo, more preferably in a patient who is in need of the nucleic acid according to the present invention, such manufacture or expression preferably uses an expression vector, preferably a mammalian expression vector. Expression vectors are known in the art and preferably comprise plasmids, cosmids, viral expression systems. Preferred viral expression systems include, but are not limited to, adenovirus, retrovirus and lentivirus.

Methods are known in the art to introduce the vectors into cells or tissues. Such methods can be found generally described in Sambrook et al., Molecular cloning: A Laboratory Manual, Cold Springs Harbour Laboratory, New York (1983, 1992), or in Ausubel et al., Current Protocols in Molecular Biology, John Wiley and Sons, Baltimore, Md., 1998.

Suitable methods comprise, among others, transfection, lipofection, electroporation and infection with recombinant viral vectors. In connection with the present invention, an additional feature of the vector is in one embodiment an expression limiting feature such as a promoter and regulatory element, respectively, that are specific for the desired cell type thus allowing the expression of the nucleic acid sequence according to the present invention only once the background is provided which allows the desired expression.

In a further aspect the present invention is related to a pharmaceutical composition comprising a nucleic acid according to the present invention and/or a vector according to the present invention and, optionally, a pharmaceutically acceptable carrier, diluent or adjuvants or other vehicle(s). Preferably, such carrier, diluents, adjuvants and vehicles are inert, and non-toxic. The pharmaceutical composition is in its various embodiments adapted for administration in various ways. Such administration comprises systemic and local administration as well as oral, subcutaneous, parenteral, intravenous, intraarterial, intramuscular, intraperitonial, intranasal, and intrategral.

In particular embodiments the RTP801L siRNA is formulated as eye drops for administration to the surface of the eye. In other embodiments the RTP801L siRNA compound is administered to the lung by inhalation. In yet other embodiments the RTP801L siRNA compound is formulated for delivery to the inner ear by transtympanic injection or via ear drops.

It will be acknowledged by the one skilled in the art that the amount of the pharmaceutical composition and the respective siRNA depends on the clinical condition of the individual patient, the site and method of administration, scheduling of administration, patient age, sex, bodyweight and other factors known to medical practitioners. The pharmaceutically effective amount for purposes of prevention and/or treatment is thus determined by such considerations as are known in the medical arts. Preferably, the amount is effective to achieve improvement including but limited to improve the diseased condition or to provide for a more rapid recovery, improvement or elimination of symptoms and other indicators as are selected as appropriate measures by those skilled in the medical arts.

In a preferred embodiment, the pharmaceutical composition according to the present invention may comprise other pharmaceutically active compounds. Preferably, such other pharmaceutically active compounds are selected from the group comprising compounds which allow for uptake intracellular cell delivery, compounds which allow for endosomal release, compounds which allow for, longer circulation time and compounds which allow for targeting of endothelial cells or pathogenic cells. Preferred compounds for endosomal release are chloroquine, and inhibitors of ATP dependent $H^+$ pumps.

The pharmaceutical composition is preferably formulated so as to provide for a single dosage administration or a multi-dosage administration.

The pharmaceutical composition according to the present invention can also be used in a method for preventing and/or treating a disease as disclosed herein, whereby the method comprises the administration of a nucleic acid according to the present invention, a vector according to the present invention or a pharmaceutical composition or medicament according to the present invention for any of the diseases described herein.

In a further aspect, the present invention is related to a method for designing or screening a nucleic acid which is suitable to down-regulate RTP801L, more particularly to down-regulate RTP801L function. This method comprises the use of a nucleic acid sequence as disclosed herein and the assessment of such nucleic acid in a suitable assay. Such assay is known in the art and, for example, described in the example part of this application. In a further step, a double-stranded nucleic acid is designed, preferably according to the design principles as laid down herein, which is suitable to down-regulate RTP801L, preferably in connection with a post transcriptional gene silencing mechanism such as RNA interference. Also the thus obtained, i.e. designed or screened, nucleic acid is assessed in the respective assay and the result, i.e. the effect of both the nucleic acid according to the present invention as well as the newly designed or screened nucleic acid in such assay compared. Preferably, the designed or screened nucleic acid is more suitable in case it is either more stable or more effective, preferably both. It will be acknowledged that the method will be particularly effective if any of the nucleic acids according to the present invention is used as a starting point. It is thus within the present invention that new nucleic acid molecules will be designed based on the principles disclosed herein, whereby the target sequence on the RTP801L mRNA will be slightly shifted relative to the target sequence on the RTP801L mRNA for the corresponding nucleic acid according to the present invention. Preferably the new nucleic acid will be shifted by at least one or more nucleotides relative to the stretch on the target mRNA in either the 5' or the 3' direction of the mRNA coding for RTP801L. It is however with in the present invention that the shift occurs in both directions simultaneously which means that the new nucleic acid incorporates the nucleic acid according to the present invention used as a starting point. It is also within the present invention that the elongation of the nucleic acid according to the present invention and used as a starting point is biased to either the 3' end or the 5' end. In case of such as bias either the 3' end or the 5' end of the new nucleic acid is longer, i.e. more extended than the other end. When the new nucleic acid molecule is generated by extending either the 3' end of the 5' end of the antisense strand and/or the sense strand, the following sequence of steps is typically applied. If the shift is to the 5' end of the mRNA of RTP801L, the 3' end of the antisense strand has to be extended by the number of the nucleotides by which the 5' end of the mRNA of RTP801L is shifted. The nucleotide(s) thus to be added to the 3' end of the antisense strand of the new nucleic acid is/are complementary to those nucleotides following at the 5' end of the target sequence on the RTP801L mRNA used for the nucleic acid molecule according to the present invention used as a starting point. The same has to be done to the sense strand. However the nucleotides to be added to the sense strand have to correspond, i.e. be complementary to the nucleotides newly added to the 3' end of the antisense strand which means that they have to be added to the 5' end of the sense strand. The latter step on the sense strand, however has to be done only to the extent that apart from the antisense strand also the sense strand shall be shifted, which is the case in preferred embodiments of the present invention. Although this shifting can be done to an extent defined by the ones skilled in the art, more preferably the shift shall be done such that also the new nucleic acid still contains a stretch of at least 14 nucleotides, preferably 14 contiguous nucleotides as exhibited by any of the nucleic acid molecules disclosed herein.

The synthesis of any of the nucleic acids described herein is within the skills of the one of the art. Such synthesis is, among others, described in Beaucage S. L. and Iyer R. P., Tetrahedron 1992; 48: 2223-2311, Beaucage S. L. and Iyer R. P., Tetrahedron 1993; 49: 6123-6194 and Caruthers M. H. et. al., Methods Enzymol. 1987; 154: 287-313, the synthesis of thioates is, among others, described in Eckstein F., Annu. Rev. Biochem. 1985; 54: 367-402, the synthesis of RNA molecules is described in Sproat B., in Humana Press 2005 Edited by Herdewijn P.; Kap. 2: 17-31 and respective downstream processes are, among others, described in Pingoud A. et. al., in IRL Press 1989 Edited by Oliver R. W. A.; Kap. 7: 183-208 and Sproat B., in Humana Press 2005 Edited by Herdewijn P.; Kap. 2: 17-31 (supra).

siRNA for RTP801L can be made using methods known in the art as described above, based on the known sequence of RTP801L (SEQ ID NO:1), and can be made stable by various modifications as described above. For further information, see Example 5.

Combination Therapy

The present invention provides for combination therapy for all the conditions disclosed herein and in particular conditions involving choroidal neovascularization. In said combination therapy, both the RTP801L and VEGFR genes are inhibited in order to ameliorate the symptoms of the disease being treated. These genes are inhibited with a combination of siRNAs or antibodies (including aptamer antibodies) or both. The present invention therefore also provides for a novel pharmaceutical composition comprising an RTP801L inhibitor and a VEGF or VEGF-1 inhibitor, the RTP801L inhibitor preferable being an siRNA, more preferably an siRNA molecule detailed in any one of Tables A-G, optionally-selected from the group consisting of the siRNAs of Table F, and the VEGF/VEGFR-1 inhibitor optionally being an antibody or aptamer. The combined use of said compounds (i.e., RTP801L siRNA and VEGF antibody or any other combined example disclosed herein) in the preparation of a medicament is also part of the present invention.

Thus, RTP801L siRNA such as an siRNA molecule detailed herein and in any one of Tables A-G and optionally siRNA Nos: DDIT4L__14 or DDIT4L__15 of Table F, are administered in conjunction with agents which target VEGF or VEGF receptor 1 (VEGFR1). Such agents currently exist on the market or in various stages of approval and work through different mechanisms. Antibodies and antibody fragments such as ranibizumab (Lucentis, Genentech) attach to released VEGF to inhibit binding of VEGF to active receptors. An aptamer which can act like a ligand/antibody (Macugen, Eyetech/Pfizer, approved recently by the FDA for wet AMD) is also a possibility. Macugen bonds with extracellular VEGF to block its activity. These drugs are administered locally by intravitreal injection. Anti-VEGF siRNA based compounds (such as Acuity's Cand5 inhibitor of VEGF or SIRNA's 027 inhibitor of VEGFR-1) are also available. Additionally, the small molecule aminosterol Squalamine (Genaera) which is administered systemically reportedly interferes in multiple facets of the angiogenic process, including inhibiting VEGF and other growth factor signaling in endothelial cells.

The conjoined administration of an RTP801L siRNA, and any of the above VEGF/VEGFR-1 inhibitory agents can have an additive or even synergistic effect whereby said combined treatment is more effective than treatment by any of these individual compositions, irrespective of dosage in the single therapy option. RTP801L siRNA has a different mechanism of action and is potentially additive or even synergistic with VEGF-VEGFR inhibitors.

Additional disorders which can be treated by the molecules and compositions of the present invention include all types of choroidal neovascularization (CNV), which occurs not only in wet AMD but also in other ocular pathologies such as ocular histoplasmosis syndrome, angiod streaks, ruptures in Bruch's membrane, myopic degeneration, ocular tumors and some retinal degenerative diseases.

An additional aspect of the present invention provides for methods of treating an apoptosis related disease. Methods for therapy of diseases or disorders associated with uncontrolled, pathological cell growth, e.g. cancer, psoriasis, autoimmune diseases, inter alia, and methods for therapy of diseases associated with ischemia and lack of proper blood flow, e.g. myocardial infarction (MI) and stroke, are provided. "Cancer" or "Tumor" refers to an uncontrolled growing mass of abnormal cells. These terms include both primary tumors, which may be benign or malignant, as well as secondary tumors, or metastases which have spread to other sites in the body. Examples of cancer-type diseases include, inter alia: carcinoma (e.g.: breast, colon and lung), leukemia such as B cell leukemia, lymphoma such as B-cell lymphoma, blastoma such as neuroblastoma and melanoma and sarcoma. It will be acknowledged that the pharmaceutical composition according to the present invention can be used for any disease which involves undesired development or growth of vasculature including angiogenesis, as well as any of the diseases and conditions described herein. Preferably, these kind of diseases are tumor diseases. Among tumor diseases, the following tumors are most preferred: endometrial cancer, colorectal carcinomas, gliomas, endometrial cancers, adenocarcinomas, endometrial hyperplasias, Cowden's syndrome, hereditary non-polyposis colorectal carcinoma, Li-Fraumene's syndrome, breast-ovarian cancer, prostate cancer (Ali, I. U., Journal of the National Cancer Institute, Vol. 92, no. 11, Jun. 7, 2000, page 861-863), Bannayan-Zonana syndrome, LDD (Lhermitte-Duklos' syndrome) (Macleod, K., supra) hamartoma-macrocephaly diseases including Cow disease (CD) and Bannayan-Ruvalcaba-Rily syndrome (BRR), mucocutaneous lesions (e.g. trichilemmonmas), macrocephaly, mental retardation, gastrointestinal harmatomas, lipomas, thyroid adenomas, fibrocystic disease of the breast, cerebellar dysplastic gangliocytoma and breast and thyroid malignancies (Vazquez, F., Sellers, W. R., supra).

The invention also provides a composition comprising one or more of the compounds of the invention in a carrier, preferably a pharmaceutically acceptable carrier. This composition may comprise a mixture of two or more siRNAs for different genes or different siRNAs for the same gene. A composition comprising siRNA for the RTP801L gene and siRNA for the VEGF gene and/or the VEGF-R1 gene is envisaged.

This invention also comprises a tandem double-stranded structure which comprises two or more siRNA sequences, which is processed intracellularly to form two or more different siRNAs, one inhibiting RTP801L and a second inhibiting VEGF/VEGFR-1 In a related aspect, this invention also comprises a tandem double-stranded structure which comprises two or more siRNA sequences, which is degraded intracellularly to form two or more different siRNAs, both inhibiting RTP801L.

In particular, it is envisaged that a long oligonucleotide (typically about 80-500 nucleotides in length) comprising one or more stem and loop structures, where stem regions comprise the sequences of the oligonucleotides of the invention, are delivered in a carrier, preferably a pharmaceutically acceptable carrier, and may be processed intracellularly by endogenous cellular complexes (e.g. by DROSHA and DICER as described above) to produce one or more smaller double stranded oligonucleotides (siRNAs) which are oligonucleotides of the invention. This oligonucleotide can be termed a tandem shRNA construct. It is envisaged that this long oligonucleotide is a single stranded oligonucleotide comprising one or more stem and loop structures, wherein each stem region comprises a sense and corresponding antisense siRNA sequence of an 801 gene. In particular, it is envisaged that this oligonucleotide comprises sense and antisense siRNA sequences as depicted in any one of Tables A-G. Alternatively, the tandem shRNA construct may comprise sense and complementary antisense siRNA sequence corresponding to an 801L gene and additionally sense and complementary antisense siRNA sequence corresponding to a different gene such as 801, VEGF or VEGF-R1.

As mentioned herein, siRNA against RTP801L are the main active component in a pharmaceutical composition, or are one active component of a pharmaceutical composition containing two or more siRNAs (or molecules which encode or endogenously produce two or more siRNAs, be it a mixture of molecules or one or more tandem molecule which encodes two or more siRNAs), said pharmaceutical composition further being comprised of one or more additional siRNA molecule which targets one or more additional gene. Simultaneous inhibition of RTP801L and said additional gene(s) has an additive or synergistic effect for treatment of the diseases disclosed herein, according to the following:

Acute Renal Failure (ARF) and other microvascular disorders: the pharmaceutical composition for treatment of ARF comprises of the following compound combinations: 1) RTP801L siRNA and p53 siRNA dimers; 2) RTP801L and Fas siRNA dimers; 3) RTP801L and Bax siRNA dimers; 4) p53 and Fas siRNA dimers; 5) RTP801L and Bax siRNA dimers; 6) RTP801L and Noxa siRNA dimers; 7) RTP801L and Puma siRNA dimers; 8) RTP801L (REDD1) and RTP801LL (REDD2) siRNA dimers; 9) RTP801L siRNA, Fas siRNA and any of RTP801LL siRNA p53 siRNA, Bax siRNA, Noxa siRNA or Puma siRNA to form timers or polymers (i.e., tandem molecules which encode three siRNAs).

Macular degeneration (MD), diabetic retinopathy (DR), spinal cord injury: pharmaceutical compositions for treatment of MD, DR and spinal cord injury comprises of the following compound combinations: 1) RTP801L siRNA combined with either of VEGF siRNA, VEGF-R1 siRNA, VEGF R2 siRNA, PKCbeta siRNA, MCP1 siRNA, eNOS siRNA, KLF2 siRNA, RTP801 siRNA (either physically mixed or in a tandem molecule); 2) RTP801L siRNA in combination with two or more siRNAs of the above list (physically mixed or in a tandem molecule encoding three siRNAs, or a combination thereof).

COPD and respiratory disorders: the pharmaceutical composition for treatment of respiratory disorders comprises of the following compound combinations: RTP801L siRNA combined with siRNA against one or more of the following genes: elastases, matrix metalloproteases, phospholipases, caspases, sphingomyelinase, RTP801 and ceramide synthase.

Further, a combination (tandem) siRNA directed against both RTP801 and RTP801L can be used to treat any of the conditions disclosed herein. For Example, the siRNA directed against RTP801 termed REDD14 (sense sequence: 5' GUGCCAACCUGAUGCAGCU 3' and antisense sequence 5' AGCUGCAUCAGGUUGGCAC 3') can be joined in tandem with any of the RTP801L siRNAs disclosed herein, such as an siRNA of Table F, or any other siRNA present in any one of Tables A-G.

Additionally, RTP801L siRNA or any nucleic acid molecule comprising or encoding RTP801L siRNA can be linked (covalently or non-covalently) to antibodies, in order to achieve enhanced targeting for treatment of the diseases disclosed herein, according to the following:
ARF: anti-Fas antibody (preferably neutralizing antibodies). Macular degeneration, diabetic retinopathy, spinal cord injury: anti-Fas antibody, anti-MCP1 antibody, anti-VEGFR1 and anti-VEGFR2 antibody. The antibodies should be preferably be neutralizing antibodies.

Any molecules, such as, for example, antisense DNA molecules which comprise the siRNA sequences disclosed herein (with the appropriate nucleic acid modifications) are particularly desirable and are used in the same capacity as their corresponding siRNAs for all uses and methods disclosed herein.

The invention also comprises a method of treating a patient suffering from a disorder such as the disorders described herein comprising administering to the patient the above composition or compound in a therapeutically effective dose so as to thereby treat the patient.
Macular Degeneration The most common cause of decreased best-corrected vision in individuals over 65 years of age in the US is the retinal disorder known as age-related macular degeneration (AMD). As AMD progresses, the disease is characterized by loss of sharp, central vision. The area of the eye affected by AMD is the Macula, a small area in the center of the retina, composed primarily of photoreceptor cells. So-called "dry" AMD, accounting for about 85%-90% of AMD patients, involves alterations in eye pigment distribution, loss of photoreceptors and diminished retinal function due to overall atrophy of cells. So-called "wet" AMD involves proliferation of abnormal choroidal vessels leading to clots or scars in the sub-retinal space. Thus, the onset of wet AMD occurs because of the formation of an abnormal choroidal neovascular network (choroidal neovascularization, CNV) beneath the neural retina. The newly formed blood vessels are excessively leaky. This leads to accumulation of subretinal fluid and blood leading to loss of visual acuity. Eventually, there is total loss of functional retina in the involved region, as a large disciform scar involving choroids and retina forms. While dry AMD patients may retain vision of decreased quality, wet AMD often results in blindness. (Hamdi & Kenney, May 2003. *Frontiers in Bioscience*, e305-314).

Acuity Pharmaceuticals and Sirna Therapeutics, have both recently filed an IND for siRNA molecules inhibiting VEGF and VEGF-R1 (Flt-1), respectively, for treatment of AMD. These molecules are termed Cand5 and Sirna-027 respectively.

Glaucoma

Glaucoma is one of the leading causes of blindness in the world. It affects approximately 66.8 million people worldwide. At least 12,000 Americans are blinded by this disease each year (Kahn and Milton, 1980. *Am J Epidemiol.* 111(6): 769-76). Glaucoma is characterized by the degeneration of axons in the optic nerve head, primarily due to elevated intraocular pressure (IOP). One of the most common forms of glaucoma, known as primary open-angle glaucoma (POAG), results from the increased resistance of aqueous humor outflow in the trabecular meshwork (TM), causing IOP elevation and eventual optic nerve damage. Mucke (IDrugs 2007, 10(1):37-41) reviews current therapeutics, including siRNA to various targets for the treatment of ocular diseases, for example, age-related macular degeneration (AMD) and glaucoma. Administration of neuroprotective agents has also been shown to be a viable treatment for glaucoma. The present invention provides RTP801L siRNA useful as a neuroprotective agent in the treatment of ION, AION, and glaucoma.

Ischemic Optic Neuropathy (ION)

A severely blinding disease resulting from loss of the arterial blood supply to the optic nerve (usually in one eye), as a result of occlusive disorders of the nutrient arteries. Optic neuropathy can be anterior (AION), which causes a pale edema of the optic disc, or posterior, in which the optic disc is not swollen and the abnormality occurs between the eyeball and the optic chiasm. Ischemic anterior optic neuropathy usually causes a loss of vision that may be sudden or occur over several days. Ischemic posterior optic neuropathy is uncommon, and the diagnosis depends largely upon exclusion of other causes, chiefly stroke and brain tumor.

Dry-Eye Syndrome

Dry eye syndrome is a common problem usually resulting from a decrease in the production of tear film that lubricates the eyes. Most patients with dry eye experience discomfort, and no vision loss; although in severe cases, the cornea may become damaged or infected. Wetting drops (artificial tears) may be used for treatment while lubricating ointments may help more severe cases.

Microvascular Disorders

Microvascular disorders are composed of a broad group of conditions that primarily affect the microscopic capillaries and lymphatics and are therefore outside the scope of direct surgical intervention. Microvascular disease can be broadly grouped into the vasospastic, the vasculitis and lymphatic occlusive. Additionally, many of the known vascular conditions have a microvascular element to them.

Microvascular Pathologies Associated with Diabetes

Diabetes is the leading cause of blindness, the major cause of amputations and impotence, and one of the most frequently occurring chronic childhood diseases. Diabetes is also the leading cause of end-stage renal disease in the United States, with a prevalence rate of 31% compared with other renal diseases. Diabetes is also the most frequent indication for kidney transplantation, accounting for 22% of all transplantation operations.

In general, diabetic complications can be classified broadly as microvascular or macrovascular disease. Microvascular complications include neuropathy (nerve damage), nephropathy (kidney disease) and vision disorders (e.g. retinopathy, glaucoma, cataract and corneal disease). In the retina, glomerulus, and vasa nervorum, similar pathophysiologic features characterize diabetes-specific microvascular disease. All the above listed conditions and pathologies are also be referred to herein as conditions "secondary to diabetes".

Emphysema and COPD

Among the mechanisms that underlie lung destruction in emphysema, excessive formation of reactive oxygen species (ROS) should be first of all mentioned. It is well established that prooxidant/antioxidant imbalance exists in the blood and in the lung tissue of smokers (Hulea S A, et al: 1995. *J Environ Pathol Toxicol Oncol.* 14(3-4):173-80; Rahman I, MacNee W. 1999. *Am J. Physiol.* 277(6 Pt 1):L1067-88; MacNee W. 2000 *Chest.* 117(5 Suppl 1):303S-17S; Marwick J A, et al., 2002. *Ann N Y Acad. Sci.* 973:278-83; Aoshiba K, et al., 2003. *Inhal Toxicol.* (10):1029-38; Dekhuijzen P N. 2004. *Eur Respir J.* 23(4):629-36; Tuder R M, et al., 2003. *Am J Respir Cell Mol Biol,* 29:88-97). After one hour exposure of mice to CS, there is a dramatic increase of 8-hydroxy-2'-deoxyguanosine (8-OHdG) in the alveolar epithelial cells, particularly of type II (see *Inhal Toxicol.* 2003 15(10):1029-38, above).

Overproduced reactive oxygen species are known for their cytotoxic activity, which stems from a direct DNA damaging effect and from the activation of apoptotic signal transduction pathways (Takahashi et al., 2004. *Brain Res Bull.* 62(6):497-504; Taniyama Y, Griendling K K. 2003. *Hypertension.* 42(6): 1075-81; Higuchi Y. 2003. *Biochem Pharmacol.* 66(8):1527-35; Punj V, Chakrabarty A M. 2003. *Cell Microbiol.* (4):225-31; Ueda et al., 2002 *Antioxid Redox Signal.* 4(3):405-14).

Both reactive oxygen species (ROS) from inhaled cigarette smoke and those endogenously formed by inflammatory cells contribute to an increased intrapulmonary oxidant burden.

One additional pathogenic factor with regards to COPD pathogenesis is the observed decreased expression of VEGF and VEGFRII in lungs of emphysematous patients (Kasahara, et al., 2001, *Am J Respir Crit Care Med.* 163:737-744). Moreover, inhibition of VEGF signaling using chemical VEGFR inhibitor leads to alveolar septal endothelial and then to epithelial cell apoptosis, probably due to disruption of intimate structural/functional connection of both types of cells within alveoli (Kasahara, et al., 2000. *J. Clin. Invest.* 106:1311-1319; Voelkel N F, Cool C D. 2003. *Eur Respir J Suppl.* 46:28s-32s).

Diabetic Neuropathy

Diabetic neuropathies are neuropathic disorders (peripheral nerve damage) associated with diabetes mellitus. These conditions usually result from diabetic microvascular injury involving small blood vessels that supply nerves (vasa nervorum). Relatively common conditions which are associated with diabetic neuropathy include third nerve palsy; mononeuropathy; mononeuropathy multiplex; diabetic amyotrophy; a painful polyneuropathy; autonomic neuropathy; and thoracoabdominal neuropathy and the most common form, peripheral neuropathy, which mainly affects the feet and legs. There are four factors involved in the development of diabetic neuropathy: microvascular disease, advanced glycated end products, protein kinase C, and the polyol pathway. The compounds of the present invention are useful in treating microvascular disease in diabetic neuropathy.

Neuropathy is a common complication of diabetes occurring over time in more than half of patients with type 2 diabetes. Nerve conduction studies demonstrate that neuropathy is already present in 10-18% of patients at the time of diabetes diagnosis, suggesting that peripheral nerve injury occurs at early stages of disease and with milder glycemic dysregulation. The concept that neuropathy is an early clinical sign of diabetes was proposed >40 years ago, and most studies report an association between IGT and neuropathy. Most patients with IGT and associated neuropathy have a symmetric, distal sensory polyneuropathy with prominent neuropathic pain. IGT neuropathy (Singleton, J R et al. 2003. 1: Diabetes 52(12):2867-73) is phenotypically similar to early diabetic neuropathy, which also causes sensory symptoms, including pain, and autonomic dysfunction.

Autonomic dysfunction, particularly erectile dysfunction and altered cardiac vagal response, are common early features of neuropathic injury in diabetes. Work with IGT patients also suggests prevalent vagal dysautonoinia: separate studies have found abnormal heart rate recovery following exercise, blunted R-R interval variability to deep breathing, and reduced expiration to inspiration ratio (all measures of vagal dysautonomia) in a greater fraction of IGT patients than age-matched normoglycemic control subjects.

For further information, see American Journal of Surgery, Volume 187• Number 5 Suppl 1• May 1, 2004, Elsevier.

Coronary Microvascular Dysfunction in Diabetes

The correlation between histopathology and microcirculatory dysfunction in diabetes is well known from old experimental studies and from autopsy, where thickening of the basal membrane, perivascular fibrosis, vascular rarefication, and capillary hemorrhage are frequently found. The following papers relate to microvascular dysfunction (Am J Physiol 2003; 285; Hypert Res 2002; 25:893; Sambuceti et al., Circulation 2001. 104:1129; Stone 2002; Feldmann Circulation 2003; Herrmann, Circulation 2001).

Diabetic Nephropathy (Renal Dysfunction in Patients with Diabetes)

Diabetic nephropathy encompasses microalbuminuria (a microvascular disease effect), proteinuria and ESRD. Diabetes is the most common cause of kidney failure, accounting for more than 40 percent of new cases. Even when drugs and diet are able to control diabetes, the disease can lead to nephropathy and kidney failure. Most people with diabetes do not develop nephropathy that is severe enough to cause kidney failure. About 16 million people in the United States have diabetes, and about 100,000 people have kidney failure as a result of diabetes.

Diabetic Retinopathy

In the diabetic state, hyperglycemia leads to decreased retinal blood flow, retinal hyperpermeability, delays in photoreceptor nerve conduction, and retinal neuronal cell death. In short duration diabetes, neuronal cell death has been identified within the inner nuclear layer of the retina. Specifically, apoptosis has been localized to glial cells such as Mueller cells and astrocytes and has been shown to occur within 1 month of diabetes in the STZ-induced diabetic rat model. The cause of these events is multi-factorial including activation of the diacylglycerol/PKC pathway, oxidative stress, and non-enzymatic glycosylation. The combination of these events renders the retina hypoxic and ultimately leads to the development of diabetic retinopathy. One possible connection between retinal ischemia and the early changes in the diabetic retina is the hypoxia-induced production of growth factors such as VEGF. The master regulator of the hypoxic response has been identified as hypoxia inducible factor-1 (HIF-1), which controls genes that regulate cellular proliferation and angiogenesis. Prior studies have demonstrated that inhibition of HIF-1 ubiquitination leads to binding with hypoxia responsive elements (HRE) and production of VEGF mRNA.

Diabetic Retinopathy is defined as the progressive dysfunction of the retinal vasculature caused by chronic hyperglycemia. Key features of diabetic retinopathy include microaneurysms, retinal hemorrhages, retinal lipid exudates, cotton-wool spots, capillary nonperfusion, macular edema and neovascularization. Associated features include vitreous hemorrhage, retinal detachment, neovascular glaucoma, premature cataract and cranial nerve palsies.

A microvascular disease that primarily affects the capillaries, diabetes mellitus affects the eye by destroying the vasculature in the conjunctiva, retina and central nervous system.

Neuropathy

Neuropathy affects all peripheral nerves: pain fibers, motor neurons, autonomic nerves. It therefore necessarily can affect all organs and systems since all are innervated. There are several distinct syndromes based on the organ systems and members affected, but these are by no means exclusive. A patient can have sensorimotor and autonomic neuropathy or any other combination. Despite advances in the understanding of the metabolic causes of neuropathy, treatments aimed at interrupting these pathological processes have been limited by side effects and lack of efficacy. Thus, treatments are symptomatic and do not address the underlying problems. Agents for pain caused by sensorimotor neuropathy include tricyclic antidepressants (TCAs), serotonin reuptake inhibitors (SSRIs) and antiepileptic drugs (AEDs). None of these agents reverse the pathological processes leading to diabetic neuropathy and none alter the relentless course of the illness. Thus, it would be useful to have a pharmaceutical composition that could better treat these conditions and/or alleviate the symptoms.

Retinal Microvasculopathy (AIDS Retinopathy)

Retinal microvasculopathy is seen in 100% of AIDS patients. It is characterized by intraretinal hemorrhages, microaneurysms, Roth spots, cotton-wool spots (microinfarctions of the nerve fiber layer) and perivascular sheathing. The etiology of the retinopathy is unknown though it has been thought to be due to circulating immune complexes, local release of cytotoxic substances, abnormal hemorheology, and HIV infection of endothelial cells. AIDS retinopathy is now so common that cotton wool spots in a patient without diabetes or hypertension but at risk for HIV should prompt the physician to consider viral testing. There is no specific treatment for AIDS retinopathy but its continued presence may prompt a physician to reexamine the efficacy of the HIV therapy and patient compliance.

Bone Marrow Transplantation (BMT) Retinopathy

Bone marrow transplantation retinopathy was first reported in 1983. It typically occurs within six months, but it can occur as late as 62 months after BMT. Risk factors such as diabetes and hypertension may facilitate the development of BMT retinopathy by heightening the ischemic microvasculopathy. There is no known age, gender or race predilection for development of BMT retinopathy. Patients present with decreased visual acuity and/or visual field deficit. Posterior segment findings are typically bilateral and symmetric. Clinical manifestations include multiple cotton wool spots, telangiectasia, microaneurysms, macular edema, hard exudates and retinal hemorrhages. Fluorescein angiography demonstrates capillary nonperfusion and dropout, intraretinal microvascular abnormalities, microaneurysms and macular edema. Although the precise etiology of BMT retinopathy has not been elucidated, it appears to be affected by several factors: cyclosporine toxicity, total body irradiation (TBI), and chemotherapeutic agents. Cyclosporine is a powerful immunomodulatory agent that suppresses graft-versus-host immune response. It may lead to endothelial cell injury and neurologic side effects, and as a result, it has been suggested as the cause of BMT retinopathy. However, BMT retinopathy can develop in the absence of cyclosporine use, and cyclosporine has not been shown to cause BMT retinopathy in autologous or syngeneic bone marrow recipients. Cyclosporine does not, therefore, appear to be the sole cause of BMT retinopathy. Total body irradiation (TBI) has also been implicated as the cause of BMT retinopathy.

Radiation injures the retinal microvasculature and leads to ischemic vasculopathy. Variables such as the total dose of radiation and the time interval between radiation and bone marrow ablation appear to be important. However, BMT retinopathy can occur in patients who did not receive TBI, and BMT retinopathy is not observed in solid organ transplant recipients who received similar doses of radiation. Thus, TBI is not the sole cause, but it is another contributing factor in development of BMT retinopathy. Chemotherapeutic agents have been suggested as a potential contributing factor in BMT retinopathy. Medications such as cisplatin, carmustine, and cyclophosphamide can cause ocular side effects including papilledema, optic neuritis, visual field deficit and cortical blindness. It has been suggested that these chemotherapeutic drugs may predispose patients to radiation-induced retinal damages and enhance the deleterious effect of radiation. In general, patients with BMT retinopathy have a good prognosis. The retinopathy usually resolves within two to four months after stopping or lowering the dosage of cyclosporine. In one report, 69 percent of patients experienced complete resolution of the retinal findings, and 46 percent of patients fully recovered their baseline visual acuity. Because of the favorable prognosis and relatively non-progressive nature of BMT retinopathy, aggressive intervention is usually not necessary.

Microvascular Diseases of the Kidney

The kidney is involved in a number of discreet clinicopathologic conditions that affect systemic and renal microvasculature. Certain of these conditions are characterized by primary injury to endothelial cells, such as: Hemolytic-uremic syndrome (HUS) and thrombotic thrombocytopenic purpura (TTP) and Radiation nephritis—The long-term consequences of renal irradiation in excess of 2500 rad.

In other kidney diseases, the microvasculature of the kidney is involved in autoimmune disorders, such as systemic sclerosis (scleroderma). Kidney involvement in systemic sclerosis manifests as a slowly progressing chronic renal disease or as scleroderma renal crisis (SRC), which is characterized by malignant hypertension and acute azotemia. It is postulated that SRC is caused by a Raynaud-like phenomenon in the kidney. Severe vasospasm leads to cortical ischemia and enhanced production of renin and angiotensin II, which in turn perpetuate renal vasoconstriction. Hormonal changes (pregnancy), physical and emotional stress, or cold temperature may trigger the Raynaud-like arterial vasospasm. The role of the renin-angiotensin system in perpetuating renal ischemia is underscored by the significant benefit of ACE inhibitors in treating SRC. In patients with SRC who progress to severe renal insufficiency despite antihypertensive treatment, dialysis becomes a necessity. Both peritoneal dialysis and hemodialysis have been employed. The End-Stage Renal Disease (ESRD) Network report on 311 patients with systemic sclerosis-induced ESRD dialyzed between 1983 and 1985 revealed a 33% survival rate at 3 years.

The renal microcirculation can also be affected in sickle cell disease, to which the kidney is particularly susceptible because of the low oxygen tension attained in the deep vessels of the renal medulla as a result of countercurrent transfer of oxygen along the vasa recta. The smaller renal arteries and arterioles can also be the site of thromboembolic injury from cholesterol-containing material dislodged from the walls of the large vessels.

Taken as a group, diseases that cause transient or permanent occlusion of renal microvasculature uniformly result in disruption of glomerular perfusion, and hence of the glomerular filtration rate, thereby constituting a serious threat to systemic homeostasis.

An additional embodiment of the present invention provides for the use of a therapeutically effective dose of an RTP801L inhibitor for the preparation of a medicament for promoting recovery in a patient suffering from any of the diseases or conditions described herein e.g. spinal cord disease or injury. In one embodiment the inhibitor is preferably an siRNA. In another embodiment the inhibitor is preferably Structure A depicted herein.

The invention has been described in an illustrative manner, and it is to be understood that the terminology which has been used is intended to be in the nature of words of description rather than of limitation.

Obviously, many modifications and variations of the present invention are possible in light of the above teachings. It is, therefore, to be understood that within the scope of the appended claims, the invention can be practiced otherwise than as specifically described.

Throughout this application, various publications, including United States patents, are referenced by author and year and patents by number. The disclosures of these publications and patents and patent applications in their entireties are hereby incorporated by reference into this application in order to more fully describe the state of the art to which this invention pertains.

Citation of any document herein is not intended as an admission that such document is pertinent prior art, or considered material to the patentability of any claim of the present application. Any statement as to content or a date of any document is based on the information available to applicant at the time of filing and does not constitute an admission as to the correctness of such a statement.

The present invention is illustrated in detail below with reference to examples, but is not to be construed as being limited thereto.

EXAMPLES

Without further elaboration, it is believed that one skilled in the art can, using the preceding description, utilize the present invention to its fullest extent. The following preferred specific embodiments are, therefore, to be construed as merely illustrative, and not limitative of the claimed invention in any way.

Standard molecular biology protocols known in the art not specifically described herein are generally followed essentially as in Sambrook et al., *Molecular cloning: A laboratory manual*, Cold Springs Harbor Laboratory, New-York (1989, 1992), and in Ausubel et al., *Current Protocols in Molecular Biology*, John Wiley and Sons, Baltimore, Md. (1988).

Standard organic synthesis protocols known in the art not specifically described herein are generally followed essentially as in *Organic Syntheses*: Vol. 1-79, editors vary, J. Wiley, New York, (1941-2003); Gewert et al., *Organic synthesis workbook*, Wiley-VCH, Weinheim (2000); Smith & March, *Advanced Organic Chemistry*, Wiley-*Interscience*; 5th ed. (2001).

Standard medicinal chemistry methods known in the art not specifically described herein are generally followed essentially as in the series "Comprehensive Medicinal Chemistry", by various authors and editors, published by Pergamon Press.

The features of the present invention disclosed in the specification, the claims and/or the drawings may both separately and in any combination thereof be material for realizing the invention in various forms thereof.

General Materials and Methods

Cell Culture

The first human cell line, namely HeLa cells (American Type Culture Collection) were cultured as follows: Hela cells (American Type Culture Collection) were cultured as described in Czauderna F et al. (Czauderna, F., et al., 2003. Nucleic Acids Res, 31, 670-82).

The second human cell line was a human keratinozyte cell line which was cultivated as follows: Human keratinocytes were cultured at 37° C. in Dulbecco's modified Eagle medium (DMEM) containing 10% FCS. The mouse cell line was B16V (American Type Culture Collection) cultured at 37° C. in Dulbecco's modified Eagle medium (DMEM) containing 10% FCS. Culture conditions were as described in Methods Find Exp Clin Pharmacol. 1997 19(4):231-9.

In each case, the cells were subject to the experiments as described herein at a density of about 50,000 cells per well and the double-stranded nucleic acid according to the present invention was added at 20 nM, whereby the double-stranded nucleic acid was complexed using 1 µg/ml of a proprietary lipid.

Induction of Hypoxia-Like Condition

The cells were treated with $CoCl_2$ for inducing a hypoxia-like condition as follows: siRNA transfections were carried out in 10-cm plates (30-50% confluency) as described by (Czauderna et al., 2003; Kretschmer et al., 2003). Briefly, siRNA were transfected by adding a preformed 10× concentrated complex of GB and lipid in serum-free medium to cells in complete medium. The total transfection volume was 10 ml. The final lipid concentration was 1.0 µg/ml; the final siRNA concentration was 20 nM unless otherwise stated. Induction of the hypoxic responses was carried out by adding $CoCl_2$ (100 µM) directly to the tissue culture medium 24 h before lysis.

Preparation of Cell Extracts and Immuno Blotting

The preparation of cell extracts and immuno blot analysis were carried out essentially as described by Klippel et al. (Klippel, A., et al., 1998. Mol Cell Biol, 18, 5699-711; Klippel, A., et al., 1996. Mol Cell Biol, 16, 4117-27). Polyclonal antibodies against full length RTP801L were generated by immunising rabbits with recombinant RTP801L protein producing bacteria from pET19-b expression vector (Merck Biosciences GmbH, Germany). The murine monoclonal anti-p110α and anti-p85 antibodies have been described by Klippel et al. (supra).

In Vitro Testing of siRNA Compounds

About 1.5-2×10⁵ tested cells (HeLa cells and/or 293T cells for siRNA targeting human genes and NRK52 (normal rat kidney proximal tubule cells) cells and/or NMuMG cells (mouse mammary epithelial cell line) for siRNA targeting the rat/mouse gene) were seeded per well in 6 wells plate (70-80% confluent). See also Example 14 hereinbelow.

About 24 hours later, cells were transfected with siRNA compounds using the Lipofectamine™ 2000 reagent (Invitrogen) at final concentrations of 5 nM or 20 nM. The cells were incubated at 37° C. in a $CO_2$ incubator for 72 h.

As positive control for transfection PTEN-Cy3 labeled siRNA compounds were used. Various chemically modified blunt ended siRNA compounds having alternating modified and unmodified ribonucleotides (modified at the 2' position of the sugar residue in both the antisense and the sense strands, wherein the moiety at the 2' position of the sugar is methoxy) and wherein the ribonucleotides at the 5' and 3' termini of the antisense strand are modified in their sugar residues, and the ribonucleotides at the 5' and 3' termini of the sense strand are unmodified in their sugar residues were tested. Another siRNA compound comprised a blunt ended structure having an antisense with an alternating pattern of methoxy moieties and a sense strand with three ribonucleotides linked by two 2'5' bridges at the 3' terminus; and another siRNA compound comprising antisense and sense strands having three ribonucleotides linked by 2'5' bridges at the 3' terminus was used. Some of the tested compounds comprised a blunt ended structure having an antisense with an alternating pattern of methoxy moieties and a sense strand with one or two L-deoxynucleotides at the 3' terminal or 3' penultimate positions.

GFP siRNA compounds were used as negative control for siRNA activity.

At 72 h after transfection cells were harvested and RNA was extracted from cells. Transfection efficiency was tested by fluorescent microscopy.

The percent of inhibition of gene expression using specific preferred siRNA structures was determined using qPCR analysis of a target gene in cells expressing the endogenous gene.

In general, the siRNAs having specific sequences that were selected for in vitro testing were specific for human and a second species such as non-human primate, rat or rabbit genes. Similar results are obtained using siRNAs having these RNA sequences and modified as described herein.

Serum Stability Experiments

Chemically modified siRNA compounds according to the present invention were tested for duplex stability in human serum, as follows:

siRNA molecules at final concentration of 7 uM were incubated at 37° C. in 100% human serum (Sigma Cat# H4522). (siRNA stock 100 uM diluted in human serum 1:14.29).

5 ul were added to 15 ul 1.5XTBE-loading buffer at different time points (0, 30 min, 1 h, 3 h, 6 h, 8 h, 10 h, 16 h and 24 h)

Samples were immediately frozen in liquid nitrogen and were kept at −20° C.

Each sample was loaded onto a non-denaturing 20% acrylamide gel, prepared according to methods known in the art.

The oligos were visualized with Ethidium bromide under UV light.

Example 1

Chemically Modified RTP801L siRNA

Table 1 hereinbelow provides a code of the modified nucleotides/unconventional moieties utilized in preparing the siRNA ologonucleotides of the present invention.

TABLE 1

| Code Nuc | modification |
|---|---|
| 5medG | 5-methyl-deoxyriboguanosine-3'-phosphate |
| c6Np | Amino modifier C6 (Glen Research 10-1906-xx) |
| dA | deoxyriboadenosine-3'-phosphate |
| dB | abasic deoxyribose-3'-phosphate |
| dC | deoxyribocytidine-3'-phosphate |
| dG | deoxyriboguanosine-3'-phosphate |
| dT | thymidine-3'-phosphate |
| dT$ | thymidine (no phosphate) |
| enaA$ | ethylene-bridged nucleic acid adenosine (no phosphate) |
| enaC | ethylene-bridged nucleic acid cytidine 3' phosphate |
| enaG | ethylene-bridged nucleic acid guanosine 3' phosphate |
| enaT | ethylene-bridged nucleic acid thymidine 3' phosphate |

TABLE 1-continued

| Code Nuc | modification |
|---|---|
| iB | inverted deoxyabasic |
| LdA | L-deoxyriboadenosine-3'-phosphate (mirror image dA) |
| LdA$ | L-deoxyriboadenosine (no phosphate) (mirror image dA) |
| LdC | L-deoxyribocytidine-3'-phosphate (mirror image dC) |
| LdC$ | L-deoxyribocytidine (no phosphate) (mirror image dC) |
| LdG | L-deoxyriboguanosine-3'-phosphate (mirror image dG) |
| LdT | L-deoxyribothymidine-3'-phosphate (mirror image dT) |
| LdT$ | L-deoxyribothymidine (no phosphate) (mirror image dT) |
| mA | 2'-O-methyladenosine-3'-phosphate |
| mA$ | 2'-O-methyladenosine (no phosphate) |
| mC | 2'-O-methylcytidine-3'-phosphate |
| mC$ | 2'-O-methylcytidine (no 3'-phosphate) |
| mG | 2'-O-methylguanosine-3'-phosphate |
| mG$ | 2'-O-methylguanosine (no phosphate) |
| mU | 2'-O-methyluridine-3'-phosphate |
| mU$ | 2'-O-methyluridine (no phosphate) |
| rA | riboadenosine-3'-phosphate |
| rA$ | riboadenosine (no phosphate) |
| rC | ribocytidine-3'-phosphate |
| rC$ | ribocytidine (no phosphate) |
| rC2p | ribocytidine-2'-phosphate |
| rG | riboguanosine-3'-phosphate |
| rG2p | riboguanosine-2'-phosphate |
| rU | ribouridine-3'-phosphate |
| rU$ | ribouridine (no phosphate) |
| rU2p | ribouridine-2'-phosphate |

Tables A-E provide antisense and sense pairs of oligonucleotides useful in synthesis of the siRNA compounds according to the present invention. All oligonucleotides are presented as 5'-3' sequences. (Hum=human, chin=chinchilla, chimp=chimpanzee, ms=mouse). Table F (FIG. 2) provides certain preferred sense and corresponding antisense oligonucleotides useful in the preparation of siRNA compounds. Table G, (FIG. 3) provides chemically modified siRNA compounds, whereby the sense and antisense sequences are provided in code according to Table 1 above. In vitro activity of the compounds is also presented in Table G. The legend for Table G is as follows:

1: Activity in 293 human cells at 20 nM. % residual transcript relative to untreated control;
2: Activity in 293 human cells at 5 nM—% residual transcript relative to untreated control;
3: Activity in rat C6 cells at 20 nM—% residual transcript relative to untreated control
4: Activity in rat C6 cells at 5 nM—% residual transcript relative to untreated control;
5. Stability in Human serum (hours) "-" refers to less than 3 hours duplex stability in 100% human serum.

FIG. 8 shows the sequence, structure, activity and serum stability of siRNA compounds according to the present invention. The oligonucleotides are presented 5'-3', with sense strand above the antisense strand.

Example 2

Experimental Models, Methods and Results Relating to Ocular Disease

The compounds of the present invention are tested in the following animal model of Choroidal neovascularization (CNV). This hallmark of wet AMD is induced in model animals by laser treatment.

A) Mouse Model

Choroidal neovascularization (CNV) induction: Choroid neovascularization (CNV), a hallmark of wet AMD, is triggered by laser photocoagulation (532 nm, 200 mW, 100 ms, 75 µm) (OcuLight GL, Iridex, Mountain View, Calif.) performed on both eyes of each mouse on day 0 by a single individual masked to drug group assignment. Laser spots are applied in a standardized fashion around the optic nerve, using a slit lamp delivery system and a cover slip as a contact lens.

Treatment Groups

CNV is induced in the following groups of mice (males 6-8 weeks of age): Both eyes of each mouse are laser-treated.
12 WT mice;
12 RTP801L Knock-Out mice;
12 WT mice injected with 0.25 µg of synthetic stabilized active anti-RTP801L siRNA in one eye and inactive anti-RTP801L siRNA (REDD8—negative control) in the fellow eye, at days 0 and 7;
12 WT mice injected with 0.25 µg of synthetic stabilized active anti-RTP801L siRNA in one eye and inactive anti-GFP siRNA (negative control) in the fellow eye at days 0 and 7;
12 WT mice injected with either 0.1 µg of synthetic stabilized active anti-RTP801L siRNA in one eye and PBS (negative control) in the fellow eye at days 0 and 7; 12 WT mice injected with either 0.05 µg of synthetic stabilized active anti-RTP801L siRNA in one eye and PBS (negative control) in the fellow eye at days 0 and 7.

Evaluation: The experiment is terminated at day 14. For evaluation, the eyes are enucleated and fixed with 4% paraformaldehyde for 30 min at 4° C. The neurosensory retina is detached and severed from the optic nerve. The remaining RPE-choroid-sclera complex is flat mounted in Immu-Mount (Vectashield Mounting Medium, Vector) and coverslipped. Flat mounts are examined with a scanning laser confocal microscope (TCS SP, Leica, Germany). Vessels are visualized by exciting with blue argon laser. Horizontal optical sections (1 µm step) are obtained from the surface of the RPE-choroid-sclera complex. The deepest focal plane in which the surrounding choroidal vascular network connecting to the lesion can be identified is judged to be the floor of the lesion. Any vessel in the laser treated area and superficial to this reference plane is judged as CNV. Images of each section are digitally stored. The area of CNV-related fluorescence is measured by computerized image analysis using the Leica TCS SP software. The summation of whole fluorescent area in each horizontal section is used as an index for the volume of CNV.

Separate WT mice are used for evaluating RTP801L mRNA expression in CNV (as well as the expression of other genes relevant to AMD) (untreated and treated with siRNA) using real-time PCR on RNA extracted from RPE/choroids, or from neural retina.

Expression profiling conducted in the mouse model of CNV revealed that the RTP801L transcript level is gradually increased in mouse Retina following CNV induction, thus indicating that RTP801L is a good target for inhibition in the treatment of AMD and other conditions which involve choroidal neovascularization.

B) Non-Human Primate Model

CNV induction: Choroidal neovascularization (CNV) is induced by perimacular laser treatment of both eyes prior to dose administration. Nine lesions are placed in the macula with a laser [OcuLight GL (532 nm) Laser Photo-coagulator with an IRIS Medical®Portable Slit Lamp Adaptor], and laser spots in the right eye mirror the placement in the left eye. The approximate laser parameters are as follows: spot size: 50-100 µm diameter; laser power: 300-700 milliwatts; exposure time: 0.1 seconds.

Treatment: Immediately following laser treatment, both eyes of all animals are subjected to a single intravitreal injection. Left eye is typically dosed with 350 ug of synthetic stabilized siRNA against RTP801L in the final volume of 50 ul, whereas the contralateral eye receives 50 ul of PBS (vehicle).

Evaluation
1. All the animals are subjected to daily examination of food consumption and body weight measurements.
2. two monkeys are euthanized at day 6 following CNV induction. Their eyes are enucleated and the posterior pole is flattened. Then the fovea region is excised and separated into choroids and neuroretina which are separately (for every animal) frozen in liquid nitrogen to be subsequently used for RNA extraction and real time PCR evaluation of RTP801L expression.
3. Fluorescein angiograms are performed pre-study, and at the end of weeks 1, 2, and 3 following CNV induction. Photographs are taken, using a fundus camera (TRC-50EX Retina Camera). Images are captured using the TOPCON IMAGEnet™ system. Fluorescein dye (10% fluorescein sodium, approximately 0.1 mL/kg) is injected via vascular access ports. Photographs are taken at several timepoints following dye injection, to include the arterial phase, early arteriovenous phase and several late arteriovenous phases in order to evaluate neovascularization and to monitor leakage of fluorescein associated with CNV lesions. Interpretation and analysis of the fluorescein angiograms is independently conducted by two ophthalmologists.

Neovascularization (NV) is assessed in early angiograms and every spot is graded according to the following scheme:
0—no signs of NV
0.5—suspicious spot
1—"hot" spot
2—NV in the laser burn
3—evident NV Leakage is assessed according to the following scheme:
0—no leakage
0.5—suspicious spot
1—evident small spot leakage
2—leakage growing with time
3—leakage greater than previous borders (evidently)

In addition, the size of every spot is compared between the early and the late angiograms using morphometric measurements, and the increase in the spot's size resulting from the leakage is calculated.

Electroretinograms (ERGs) are recorded using an Epic 2000 electroretinograph according to Sierra's SOPs and the study-specific SOP, including the use of the Ganzfield apparatus, at prestudy and in the end of week 3. The tabulated ERG data are evaluated by a veterinary ophthalmologist.

C) Efficacy of Combination Therapy of RTP801L siRNA and Anti-VEGF Antibody

The efficacy of combination therapy of RTP801L siRNA and anti-VEGF antibody or aptamer (such as macugen) in the treatment of diseases in which CNV occurs is tested in the above mouse CNV model.

A) CNV volume studies: The volume of choroidal neovascularization (CNV) 3 weeks after laser injury is computed byconfocal fluorescence microscopy as previously described (Sakurai et al. *IOVS* 2003; 44: 3578-85 & Sakurai et al. *IOVS* 2003; 44: 2743-2749).

B) CNV leakage studies

Experiment 1

This experiment was designed in order to identify a potential additive or synergistic therapeutic effect of inhibition of VEGF and RTP801L in the model of laser-induced choroid neovascularization in mice Materials: Chemically modified RTP801L siRNA; negative control siRNA (GFP or scrambled); Anti-VEGF antibodies or Macugen™ and negative control.

CNV is induced on day zero as described above; the test material is injected to the subjects on day zero and day 7.

The results are evaluated by Fluorescein angiography on weeks 1, 2, 3, and by CNV volume measurement on week 3.

Experimental Groups:
VEGF Ab or macugen 0.5 ng/eye
VEGF Ab or macugen 1 ng/eye
VEGF Ab or macugen 2 ng/eye
VEGF Ab 4 or macugen ng/eye
RTP801L siRNA 0.05 ug/eye
RTP801L siRNA 0.1 ug/eye
RTP801L siRNA 0.25 ug/eye
RTP801L siRNA 0.05 ug/eye+VEGF Ab or macugen 1 ng/eye
RTP801L siRNA 0.1 ug/eye+VEGF Ab or macugen 1 ng/eye
RTP801L siRNA 0.25 ug/eye+VEGF Ab or macugen 1 ng/eye Control Groups:
PBS
Non-specific IgG 2 ng/eye
negative control 0.1 ug/eye
negative control 0.1 ug/eye+VEGF Ab or macugen 1 ng/eye The results show an additive or synergistic therapeutic effect of inhibition of VEGF and RTP801L Experiment 2

This experiment was designed in order to study the effect of RTP801L siRNA on gene expression in RPE and neural retina.

Experimental Design

Groups:
PBS
RTP801L siRNA 0.25 mg

CNV is induced by laser treatment as described above on day zero; the test material is also injected on day zero, and the effect evaluated by qPCR analysis of gene expression in RPE and neural retina on days zero and 5.

Additional AMD models which are used to test the methods of the present invention:

Ccl-2 or Ccr-2 deficient animals—deficiency in either of these proteins causes the development of some of the main features of AMD. Animals deficient in these proteins can be used to test the methods of the present invention.

For further information on AMD animal models, see: Chader, *Vision research* 42 (2002) 393-399; Ambati et al., *Nature Medicine* 9(11) (2003) 1390-1397; Tolentino et al., *Retina* 24 (2004) 132-138.

Example 3

Models and Results Relating to COPD and Emphysema

The compounds of the present invention are tested in the following an animal models and are shown to prevent emphysema:

Cigarette smoke-induced emphysema model: chronic exposure to cigarette smoke causes emphysema in several animals such as, inter alia, mouse, guinea pig.
Lung protease activity as a trigger of emphysema.
VEGFR inhibition model of emphysema.
Bronchial instillation with human neutrophil/pancreatic elastase in rodents.
MMP (matrix metalloprotease)-induced emphysema.
Inflammation-induced emphysema.

Additionally, emphysema models are generated through genetic means (e.g., mice carrying the TSK mutation), and emphysematous animals may be generated by known modifiers of susceptibility to emphysema such as, inter alia, lung injury, alveolar hypoplasia, hyperoxia, glucocorticoid treatment and nutrition.

Evaluation of the influence of lack of RTP801L on disease progression in mouse models of emphysema by inhibiting endogenous RTP801L employing intralung delivery RTP801L-inactivating siRNA CS-induced inflammation is induced by 7 day smoking in 2 groups of C57BL6 mice, 10 mice per group. Group 1: CS+delivery of control siRNA; Group 2: CS+RTP801L siRNA. Control groups of mice are instilled with either type of siRNA but kept in room air conditions. The lungs are subsequently agarose-inflated, fixed and imbedded in paraffin, and development oxidative stress in the KO mice is assessed by:

a) immunohistochemical localization and quantitation of 8-oxo-dG in the lung sections;
 b) immunohistochemical localization and quantitation of active caspase 3 in the lung sections using specific antibodies, or quantitative evaluation of the number of TUNEL-positive cells;
 c) measurement of ceramide concentration in the lung extracts;
 d) measurement of caspase activity in the lung extracts.

Methods

Exposure to Cigarette Smoking (CS)

Exposure is carried out (7 h/day, 7 days/week) by burning 2R4F reference cigarettes (2.45 mg nicotine per cigarette; purchased from the Tobacco Research Institute, University of Kentucky, Lexington, Ky., USA) using a smoking machine (Model TE-10, Teague Enterprises, Davis, Calif., USA). Each smoldering cigarette is puffed for 2 s, once every minute for a total of eight puffs, at a flow rate of 1.05 L/min, to provide a standard puff of 35 cm3. The smoke machine is adjusted to produce a mixture of sidestream smoke (89%) and mainstream smoke (11%) by burning five cigarettes at one time. Chamber atmosphere is monitored for total suspended particulates and carbon monoxide, with concentrations of 90 mg/m3 and 350 ppm, respectively.

Morphologic and Morphometric Analyses

After exposing the mice to CS or instillation of chemically modified RTP801L the mice are anesthetized with halothane and the lungs are inflated with 0.5% low-melting agarose at a constant pressure of 25 cm as previously described. The inflated lungs are fixed in 10% buffered formalin and embedded in paraffin. Sections (5 μm) are stained with hematoxylin and eosin. Mean alveolar diameter, alveolar length, and mean linear intercepts are determined by computer-assisted morphometry with the Image Pro Plus software (Media Cybernetics, Silver Spring, Md., USA). The lung sections in each group are coded and representative images (15 per lung section) are acquired by an investigator masked to the identity of the slides, with a Nikon E800 microscope, 20× lens. The results show that siRNA to 801L prevents emphysema caused by smoking as measured by the four parameters described above.

Bronchoalveolar Lavage (BAL) and Phenotyping

Following exposure to CS or instillation of chemically modified RTP801L, the mice are anesthetized with sodium pentobarbital. The BAL fluid collected from the lungs of the mice is centrifuged (500 'g at 4° C.), and the cell pellet is resuspended in phosphate-buffered saline. The total number of cells in the lavage fluid is determined, and 2×104 cells are cytocentrifuged (Shandon Southern Products, Pittsburgh, Pa., USA) onto glass slides and stained with Wright-Giemsa stain. Differential cell counts are performed on 300 cells, according to standard cytologic techniques.

Identification of Alveolar Apoptotic Cell Populations in the Lungs.

To identify the different alveolar cell types undergoing apoptosis in the lungs, an immunohistochemical staining of active caspase 3 is performed in the lung sections from the room air (RA) as well as CS exposed mice. To identify the apoptotic type II epithelial cells in the lungs, after active caspase 3 labeling, the lung sections are incubated first with anti-mouse surfactant protein C (SpC) antibody and then with an anti-rabbit Texas red antibody. Apoptotic endothelial cells are identified by incubating the sections first with the anti-mouse CD 31 antibody and then with the biotinylated rabbit anti-mouse secondary antibody. The lung sections are rinsed in PBS and then incubated with the streptavidin-Texas red conjugated complex. The apoptotic macrophages in the lungs are identified by incubating the sections first with the rat anti-mouse Mac-3 antibody and then with the anti-rat Texas red antibody. Finally, DAPI is applied to all lung sections, incubated for 5 minutes, washed and mounted with Vectashield HardSet mounting medium. DAPI and fluorescein are visualized at 330-380 nm and 465-495 nm, respectively. Images of the lung sections are acquired with the Nikon E800 microscope, 40× lens.

Immunohistochemical Localization of Active Caspase-3

Immunohistochemical staining of active caspase-3 assay is performed using anti-active caspase-3 antibody and the active caspase-3-positive cells are counted with a macro, using Image Pro Plus program. The counts are normalized by the sum of the alveolar profiles herein named as alveolar length and expressed in μm. Alveolar length correlates inversely with mean linear intercept, i.e., as the alveolar septa are destroyed, mean linear intercepts increases as total alveolar length, i.e., total alveolar septal length decreases.

Caspase 3 Activity Assay

The caspase-3/7 activity is measured in lung tissue extracts using a fluorometric assay according to the manufacturer's instructions. Snap-frozen lung tissue (n=3 per group) was homogenized with the assay buffer, followed by sonication and centrifugation at 800×g. After removal of nuclei and cellular debris, the supernatant (300 μg protein) is then incubated with the pro-fluorescent substrate at room temperature for 1 h and the fluorescence intensity was measured utilizing a Typhoon phosphoimager (Amersham Biosciences, Inc., Piscataway, N.J., USA). The results are expressed as the rate of specific caspase-3 substrate cleavage, expressed in units of caspase 3 enzymatic activity, normalized by total protein concentration. Active recombinant caspase 3 was utilized as the assay standard (0-4 U). Tissue lysates without substrate, assay buffer alone, and lysates with caspase 3 inhibitor were utilized as negative controls.

Immunohistochemical Localization of 8-Oxo-dG

For the immunohistochemical localization and quantification of 8-oxo-dG, lung sections from the mice exposed to CS or instilled with chemically modified RTP801L are incubated with anti-8-oxo-dG antibody and stained using InnoGenex™ Iso-IHC DAB kit using mouse antibodies. The 8-oxo-dG-positive cells are counted with a macro (using Image Pro Plus), and the counts were normalized by alveolar length as described.

Installation of siRNA into Mouse Lungs

Chemically modified RTP801L (50 ug) is delivered in 80 ul sterile perfluorocarbon. The oxygen carrying properties of perfluorocarbon make it well-tolerated at these volumes, while its physical-chemical properties allow for extremely efficient distal lung delivery when instilled intratracheally.

Mice are anesthetized by brief inhalational halothane exposure, the tongue is gently pulled forward by forceps and the trachea instilled with perfluorocarbon solution applied at the base of the tongue via a blunt angiocatheter.

Mice are anesthetized with an intra-peritoneal injection of Ketamine/Xylazine (115/22 mg/kg). 50 µg of siRNA is instilled intranasally in 50 µl volume of 0.9% NaCl by delivering five consecutive 10 µl portions. At the end of the intranasal instillation, the mouse's head is held straight up for 1 minute to ensure that all the instilled solution drains inside.

For further information, see: Rangasamy T, et al., 2004. *J.C.I.* 114(9):1248-59; Kasahara, Y et al., *Am J Respir Crit. Care Med* Vol 163. pp 737-744, 2001; Kasahara, Y et al., 2000. *J. Clin. Invest.* 106:1311-1319; and Tuder, R M et al., *Pulmonary Pharmacology & Therpaeutics* 2002.

Example 4

Models and Results Relating to Microvascular Disorders

The compounds of the present invention are tested in animal models of a range of microvascular disorders as described below.

1. Diabetic Retinopathy

RTP801L promotes neuronal cell apoptosis and generation of reactive oxygen species in vitro. Experiment 1: Diabetes is induced in 8 wk old RTP801L KO and C57/129sv wildtype (WT) littermate mice by intraperitoneal injection of STZ. After 4 weeks, ERG (single white flash, $1.4 \times 10^4$ ftc, 5 ms) is obtained from the left eye after 1 hour of dark adaptation. RVP is assessed from both eyes using the Evans-blue albumin permeation technique.

Experiment 2: Diabetes is induced in RTP801L knockout and in control wild type mice with the matched genetic background. In addition, it is induced in C57B16 mice, which are subsequently used for intravitreal injection of anti-RTP801L and control siRNAs. For diabetes induction, the mice are injected with streptozotocin (STZ 90 mg/kg/d for 2 days after overnight fast). Animal physiology is monitored throughout the study for changes in blood glucose, body weight, and hematocrit. Vehicle-injected mice serve as controls. The appropriate animals are treated by intravitreal injections of 1µg of RTP801L siRNA or 1µg of GFP control siRNA. siRNA is injected twice in the course of the study—on day 0, when the first STZ injection is performed, and on day 14 after the STZ injection.

Retinal vascular leakage is measured using the Evans-blue (EB) dye technique on the animals after 4 weeks duration of diabetes. Mice have a catheter implanted into the right jugular vein 24 hours prior to Evans Blue (EB) measurements. Retinal permeability measurements in both eyes of each animal follows a standard Evans-blue protocol.

2. Retinopathy of Prematurity

Retinopathy of prematurity is induced by exposing the test animals to hypoxic and hyperoxic conditions, and subsequently testing the effects on the retina.

3. Myocardial Infarction

Myocardial infarction is induced by Left Anterior Descending artery ligation in mice, both short term and long term.

4. Microvascular Ischemic Conditions

Animal models for assessing ischemic conditions include:

1. Closed Head Injury (CHI)—Experimental TBI produces a series of events contributing to neurological and neurometabolic cascades, which are related to the degree and extent of behavioral deficits. CHI is induced under anesthesia, while a weight is allowed to free-fall from a prefixed height (Chen et al, J. Neurotrauma 13, 557, 1996) over the exposed skull covering the left hemisphere in the midcoronal plane.

2. Transient middle cerebral artery occlusion (MCAO)— a 90 to 120 minutes transient focal ischemia is performed in adult, male Sprague Dawley rats, 300-370 gr. The method employed is the intraluminal suture MCAO (Longa et al., Stroke, 30, 84, 1989, and Dogan et al., J. Neurochem. 72, 765, 1999). Briefly, under halothane anesthesia, a 3-0-nylon suture material coated with Poly-L-Lysine is inserted into the right internal carotid artery (ICA) through a hole in the external carotid artery. The nylon thread is pushed into the ICA to the right MCA origin (20-23 mm). 90-120 minutes later the thread is pulled off, the animal is closed and allowed to recover.

3. Permanent middle cerebral artery occlusion (MCAO)— occlusion is permanent, unilateral-induced by electrocoagulation of MCA. Both methods lead to focal brain ischemia of the ipsilateral side of the brain cortex leaving the contralateral side intact (control). The left MCA is exposed via a temporal craniectomy, as described for rats by Tamura A., et al., *J Cereb Blood Flow Metab.* 1981; 1:53-60. The MCA and its lenticulostriatal branch are occluded proximally to the medial border of the olfactory tract with microbipolar coagulation. The wound is sutured, and animals returned to their home cage in a room warmed at 26° C. to 28° C. The temperature of the animals is maintained all the time with an automatic thermostat.

5. Acute Renal Failure (ARF)

Testing active siRNA for treating ARF is done using sepsis-induced ARF or ischemia-reperfusion-induced ARF.

1. Sepsis induced ARF

Two predictive animal models of sepsis-induced ARF are described by Miyaji T, et al., Kidney Int. 64(5):1620-31. These two models are lipopolysaccharide administration and cecal ligation puncture in mice, preferably in aged mice.

2. Ischemia-Reperfusion-Induced ARF

This predictive animal model is described by Kelly K J, et al., 2003. J Am Soc Nephrol.; 14(1):128-38.

Ischemia-reperfusion injury is induced in rats following 45 minutes bilateral kidney arterial clamp and subsequent release of the clamp to allow 24 hours of reperfusion. RTP801L siRNA or GFP siRNA (negative control) are injected into the jugular vein 2 hrs prior to and 30 minutes following the clamp. Additional siRNA is given via the tail vein at 4 and 8 hrs after the clamp. ARF progression is monitored by measurement of serum creatinine levels before and 24 hrs post surgery. At the end of the experiment, the rats are perfused via an indwelling femoral line with warm PBS followed by 4% paraformaldehyde. The left kidneys are removed and stored in 4% paraformaldehyde for subsequent histological analysis. Acute renal failure is frequently defined as an acute increase of the serum creatinine level from baseline. An increase of at least 0.5 mg per dL or 44.2 µmol per L of serum creatinine is considered as an indication for acute renal failure. Serum creatinine is measured at time zero before the surgery and at 24 hours post ARF surgery. siRNA to 801L prevents production of ARF in this model.

To study the distribution of siRNA in the rat kidney, Cy3-labeled 19-mer blunt-ended siRNA molecules (2 mg/kg) having alternating O-methyl modification in the sugar residues were administered iv for 3-5 min, after which in vivo imaging was conducted using two-photon confocal microscopy. The confocal microscopy analysis revealed that the majority of siRNA in the kidneys is concentrated in the endosomal compartment of proximal tubular cells. Both endosomal and cytoplasmic siRNA fluorescence were relatively stable during the first 2 hrs post delivery and disappeared at 24 hrs.

The expression of RTP801L during ischemia-reperfurion induced ARF was examined in rat kidneys. In both kidney regions, cortex and medulla, RTP801L transcript level is decreased in the ARF-10 hr group relative to the control group transcript level. RTP801L transcript level is also elevated (up-regulated) in the kidney medulla, 3 and 6 hrs following the ARF operation (bilateral renal artery clamp).

Example 5

Selection and Preparation of siRNAs

Using proprietary algorithms and the known sequence of the mRNA of gene RTP801L (SEQ ID NO:1), the sequences of many potential siRNAs were generated. siRNA molecules according to the above specifications were prepared essentially as described herein.

The siRNAs of the present invention can be synthesized by any of the methods which are well-known in the art for synthesis of ribonucleic (or deoxyribonucleic) oligonucleotides. For example, a commercially available machine (available, inter alia, from Applied Biosystems) can be used; the oligonucleotides are prepared according to the sequences disclosed herein. Overlapping pairs of chemically synthesized fragments can be ligated using methods well known in the art (e.g., see U.S. Pat. No. 6,121,426). The strands are synthesized separately and then are annealed to each other in the tube. Then, the double-stranded siRNAs are separated from the single-stranded oligonucleotides that were not annealed (e.g. because of the excess of one of them) by HPLC. In relation to the siRNAs or siRNA fragments of the present invention, two or more such sequences can be synthesized and linked together for use in the present invention.

The siRNA molecules of the invention are synthesized by procedures known in the art e.g. the procedures as described in Usman et al., 1987, *J. Am. Chem. Soc.,* 109, 7845; Scaringe et al., 1990, *Nucleic Acids Res.,* 18, 5433; Wincott et al., 1995, *Nucleic Acids Res,* 23, 2677-2684; and Wincott et al., 1997, *Methods Mol. Bio.,* 74, 59, and may make use of common nucleic acid protecting and coupling groups, such as dimethoxytrityl at the 5'-end, and phosphoramidites at the 3'-end. The modified (e.g. 2'-O-methylated) nucleotides and unmodified nucleotides are incorporated as desired.

Alternatively, the nucleic acid molecules of the present invention can be synthesized separately and joined together post-synthetically, for example, by ligation (Moore et al., 1992, *Science* 256, 9923; Draper et al., International PCT publication No. WO93/23569; Shabarova et al., 1991, *Nucleic Acids Research* 19, 4247; Bellon et al., 1997, *Nucleosides & Nucleotides,* 16, 951; Bellon et al., 1997, *Bioconjugate Chem.* 8, 204), or by hybridization following synthesis and/or deprotection.

The siRNA molecules of the invention can also be synthesized via a tandem synthesis methodology, as described in US patent application publication No. US2004/0019001 (McSwiggen) wherein both siRNA strands are synthesized as a single contiguous oligonucleotide fragment or strand separated by a cleavable linker which is subsequently cleaved to provide separate siRNA fragments or strands that hybridize and permit purification of the siRNA duplex. The linker can be a polynucleotide linker or a non-nucleotide linker. Note that in the attached Table A, the sense and antisense strands of siRNAs have SEQ ID NOS: 2-1851.

Similarly, the sense and antisense strands of the siRNAs in attached tables B-F have SEQ ID NOS:1852-6927.

Further note that the coding region of gene RTP801L, as presented in FIG. 1, is between nucleotides 204-785. Therefore, any siRNA within this region targets the coding region of RTP801L, and any siRNA outside this region targets the non-coding region of RTP801L i.e. the 5'UTR or the 3' UTR. The exact region targeted by each siRNA is given in the above Tables.

Additionally, sequences presented in the Tables are depicted in the 5' to 3' direction.

Example 6

Pharmacology and Drug Delivery

The compounds or pharmaceutical compositions of the present invention are administered and dosed in accordance with good medical practice, taking into account the clinical condition of the individual patient, the disease to be treated, the site and method of administration, scheduling of administration, patient age, sex, body weight and other factors known to medical practitioners.

The pharmaceutically "effective amount" for purposes herein is thus determined by such considerations as are known in the art. The amount must be effective to achieve improvement including but not limited to improved survival rate or more rapid recovery, or improvement or elimination of symptoms and other indicators as are selected as appropriate measures by those skilled in the art.

The treatment generally has a length proportional to the length of the disease process and drug effectiveness and the patient species being treated. It is noted that humans are treated generally longer than the mice or other experimental animals exemplified herein.

The compounds of the present invention are administered by any of the conventional routes of administration. It should be noted that the compound can be administered as the compound or as pharmaceutically acceptable salt and can be administered alone or as an active ingredient in combination with pharmaceutically acceptable carriers, solvents, diluents, excipients, adjuvants and vehicles. The compounds can be administered orally, subcutaneously or parenterally including intravenous, intraarterial, intramuscular, intraperitoneally, and intranasal administration as well as intrathecal and infusion techniques. Implants of the compounds are also useful. Liquid forms are prepared for injection, the term including subcutaneous, transdermal, intravenous, intramuscular, intrathecal, and other parental routes of administration. The liquid compositions include aqueous solutions, with and without organic cosolvents, aqueous or oil suspensions, emulsions with edible oils, as well as similar pharmaceutical vehicles. In addition, under certain circumstances the compositions for use in the novel treatments of the present invention are formed as aerosols, for intranasal and like administration. The patient being treated is a warm-blooded animal and, in particular, mammals including man. The pharmaceutically acceptable carriers, solvents, diluents, excipients, adjuvants and vehicles as well as implant carriers generally refer to inert, non-toxic solid or liquid fillers, diluents or encapsulating material not reacting with the active ingredients of the invention.

When administering the compound of the present invention parenterally, it is generally formulated in a unit dosage injectable form (solution, suspension, emulsion). The pharmaceutical formulations suitable for injection include sterile aqueous solutions or dispersions and sterile powders for reconstitution into sterile injectable solutions or dispersions.

The carrier can be a solvent or dispersing medium containing, for example, water, ethanol, polyol (for example, glycerol, propylene glycol, liquid polyethylene glycol, and the like), suitable mixtures thereof, and vegetable oils.

Proper fluidity can be maintained, for example, by the use of a coating such as lecithin, by the maintenance of the required particle size in the case of dispersion and by the use of surfactants. Nonaqueous vehicles such a cottonseed oil, sesame oil, olive oil, soybean oil, corn oil, sunflower oil, or peanut oil and esters, such as isopropyl myristate, can also be used as solvent systems for compound compositions. Additionally, various additives which enhance the stability, sterility, and isotonicity of the compositions, including antimicrobial preservatives, antioxidants, chelating agents, and buffers, can be added. Prevention of the action of microorganisms can be ensured by various antibacterial and antifungal agents, for example, parabens, chlorobutanol, phenol, sorbic acid, and the like. In many cases, it is desirable to include isotonic agents, for example, sugars, sodium chloride, and the like. Prolonged absorption of the injectable pharmaceutical form can be brought about by the use of agents delaying absorption, for example, aluminum monostearate and gelatin. According to the present invention, however, any vehicle, diluent, or additive used have to be compatible with the compounds.

Sterile injectable solutions can be prepared by incorporating the compounds utilized in practicing the present invention in the required amount of the appropriate solvent with various of the other ingredients, as desired.

A pharmacological formulation of the present invention can be administered to the patient in an injectable formulation containing any compatible carrier, such as various vehicle, adjuvants, additives, and diluents; or the compounds utilized in the present invention can be administered parenterally to the patient in the form of slow-release subcutaneous implants or targeted delivery systems such as monoclonal antibodies, vectored delivery, iontophoretic, polymer matrices, liposomes, and microspheres. Examples of delivery systems useful in the present invention include U.S. Pat. Nos. 5,225,182; 5,169,383; 5,167,616; 4,959,217; 4,925,678; 4,487,603; 4,486,194; 4,447,233; 4,447,224; 4,439,196; and 4,475,196. Many other such implants, delivery systems, and modules are well known to those skilled in the art.

A pharmacological formulation of the compound utilized in the present invention can be administered orally to the patient. Conventional methods such as administering the compound in tablets, suspensions, solutions, emulsions, capsules, powders, syrups and the like are usable. Known techniques which deliver it orally or intravenously and retain the biological activity are preferred. In one embodiment, the compound of the present invention can be administered initially by intravenous injection to bring blood levels to a suitable level. The patient's levels are then maintained by an oral dosage form, although other forms of administration, dependent upon the patient's condition and as indicated above, can be used.

In general, the active dose of compound for humans is in the range of from 1 ng/kg to about 20-100 mg/kg body weight per day, preferably about 0.01 mg to about 2-10 mg/kg body weight per day, in a regimen of one dose per day or twice or three or more times per day for a period of 1-2 weeks or longer, preferably for 24- to 48 hrs or by continuous infusion during a period of 1-2 weeks or longer.

Administration of Compounds of the Present Invention to the Eye

The compounds of the present invention can be administered to the eye topically or in the form of an injection, such as an intravitreal injection, a sub-retinal injection or a bilateral injection. Preferred methods of delivery to the eye is using siRNA dormulated as eye drops.

Further information on administration of the compounds of the present invention can be found in Tolentino et al., *Retina* 24 (2004) 132-138; Reich et al., *Molecular vision* 9 (2003) 210-216.

Pulmonary Administration of Compounds of the Present Invention

The therapeutic compositions of the present invention are preferably administered into the lung by inhalation of an aerosol containing these compositions/compounds, or by intranasal or intratracheal instillation of said compositions. Formulating the compositions in liposomes may benefit absorption. Additionally, the compositions may include a PFC liquid such as perflubron, and the compositions formulated as a complex of the compounds of the invention with polyethylemeimine (PEI).

For further information on pulmonary delivery of pharmaceutical compositions see Weiss et al., *Human gene therapy* 10:2287-2293 (1999); Densmore et al., *Molecular therapy* 1:180-188 (1999); Gautam et al., *Molecular therapy* 3:551-556 (2001); and Shahiwala & Misra, *AAPS PharmSciTech* 5 (2004). Additionally, respiratory formulations for siRNA are described in U.S. patent application No. 2004/0063654 of Davis et el.

Further, the compounds of the present invention are administered topically where appropriate (such as in the case of diabetic foot ulcers for example), optionally in a lipid/liposome formulation, or for use in iontophoresis.

A preferred administration mode is topical delivery of the RTP801L inhibitors onto the round window membrane of the cochlea as disclosed for example in Tanaka et al. (*Hear Res.* 2003; 177(1-2):21-31). Preferred delivery to the inner ear comprising administering the siRNA as an ear drop formulation.

In the treatment of pressure sores or other wounds, the administration of the pharmaceutical composition is preferably by topical application to the damages area, but the compositions may also be administered systemically.

Additional formulations for improved delivery of the compounds of the present invention can include non-formulated compounds, compounds covalently bound to cholesterol, and compounds bound to targeting antibodies (Song et al., 2005. *Nat. Biotechnol.* 23(6):709-17).

Example 7

Model Systems for Pressure Sores or Pressure Ulcers

Pressure sores or pressure ulcers including diabetic ulcers, are areas of damaged skin and tissue that develop when sustained pressure (usually from a bed or wheelchair) cuts off circulation to vulnerable parts of the body, especially the skin on the buttocks, hips and heels. The lack of adequate blood flow leads to ischemic necrosis and ulceration of the affected tissue. Pressure sores occur most often in patients with diminished or absent sensation or who are debilitated, emaciated, paralyzed, or long bedridden. Tissues over the sacrum, ischia, greater trochanters, external malleoli, and heels are especially susceptible; other sites may be involved depending on the patient's situation.

Testing the active inhibitors of the invention (such as siRNA) for treating pressure sore, ulcers and similar wounds is done in the mouse model described in Reid R R, et al., J Surgical Research. 116: 172-180, 2004.

Additionally, a rabbit model is described by Mustoe et al, JCI, 1991; Ahn & Mustoe, Ann PI Surg, 1991 and is used for testing the siRNAs of the invention.

Example 8

Model Systems for Spinal Cord Injury

Spinal cord injury, or myelopathy, is a disturbance of the spinal cord that results in loss of sensation and/or mobility. The two common types of spinal cord injury are due to trauma and disease. Traumatic injury can be due to automobile accidents, falls, gunshot, diving accidents inter alia, and diseases which can affect the spinal cord include polio, spina bifida, tumors and Friedreich's ataxia.

Testing the active inhibitors of the invention (such as siRNA) for treating spinal cord injury is done in the rat spinal cord contusion model as described by Young, W. in *Prog Brain Res.* 2002; 137:231-55. Other predictive animal models of spinal cord injury are described in the following references: Gruner, J A 1992. *J Neurotrauma* 9(2): 123; Hasegawa, K. and M. Grumet 2003. *J Neurosurg* 98(5): 1065-71; and Huang, P P and W. Young (1994). *J Neurotrauma* 11(5): 547.

Example 9

Model Systems for Glaucoma

Testing the active inhibitors of the invention (such as siRNA) for treating or preventing Glaucoma is done in the animal model for example as described by Pease et al., J. Glaucoma, 2006, 15(6):512-9 (Manometric calibration and comparison of TonoLab and TonoPen tonometers in rats with experimental glaucoma and in normal mice).
Rat Optic Nerve Crush (ONC) Model: Intravitreal siRNA Delivery and Eye Drop Delivery For optic nerve transsection the orbital optic nerve (ON) of anesthetized rats is exposed through a supraorbital approach, the meninges severed and all axons in the ON transected by crushing with forceps for 10 seconds, 2 mm from the lamina cribrosa.

The siRNA compounds are delivered alone or in combination in 5 uL volume (10 ug/uL) as eye drops. Immediately after optic nerve crush (ONC), 20 ug/10 ul test siRNA or 10 ul PBS is administered to one or both eyes of adult Wistar rats and the levels of siRNA taken up into the dissected and snap frozen whole retinae at 5 h and 1 d, and later at 2 d, 4 d, 7 d, 14 d and 21 d post injection is determined. Similar experiments are performed in order to test activity and efficacy of siRNA administered via eye drops.

Example 10

Model Systems for Ischemia and Reperfusion Injury Following Lung Transplantation in Rats Testing the active inhibitors of e invention (such as siRNA) for treating or preventing Ischemia and reperfusion injury following lung transplantation is done in the animal model for example as described by Mizobuchi et al., J. Heart Lung Transplant 2004: 23:889-93.

Example 11

Model Systems for Acute Lung Injury (ALI)

Intratracheal (i.t) administration of LPS (Lipopolysaccharide), a bacterial cell wall component, is an accepted experimental model of acute lung injury (ALI), as LPS stimulates profound lung recruitment of inflammatory cells and the subsequent development of systemic inflammation.

(See, for example, Fang W F, et al., Am J Physiol Lung Cell Mol. Physiol. 2007 293(2):L336-44; Hagiwara S, Iwasaka H, Noguchi T. J Anesth. 2007; 21(2):164-70).

Time-dependent changes of RTP801L gene expression in mice lungs during the first 24 hours (time points 0.5; 1; 2; 4; 8 & 24 hours), after Intratracheal (i.t) administration of LPS was assessed. The assessment of gene expression was done using qPCR.

The results indicate that the level of the RTP801L transcript is gradually decreased following LPS instillation.

Example 12

Model Systems for Acute Respiratory Distress Syndrome

Testing the active inhibitors of the invention (such as siRNA) for treating Acute respiratory distress syndrome is performed, inter alia, in the animal model as described by Chen et al. in J Biomed Sci. 2003; 10(6 Pt 1):588-92.

Example 13

Model Systems for Hearing Loss Conditions (i) Animal Model of Carboplatin-Induced or Cisplatin-Induced Hair Cell Death in the Cochlea of Chinchilla:

Chinchillas are pre-treated by direct administration of specific siRNAs to RTP801L in saline to the left ear of each animal. Saline is given to the right ear of each animal as placebo. Two days following the administration of the specific siRNA, the animals are treated with carboplatin (75 mg/kg ip) or cisplatin (intraperitoneal infusion of 13 mg/kg over 30 minutes). After sacrifice of the chinchillas (two weeks post carboplatin treatment) the percentage of dead cells of inner hair cells (IHC) and outer hair cells (OHC) is calculated in the left ear (siRNA treated) and in the right ear (saline treated). The percentage of dead cells is lower in the siRNA treated ear than in the control (ii) Animal Model of Acoustic-Induced Hair Cell Death in the Cochlea of Chinchilla:

The activity of specific siRNA to RTP801L (e.g. chemically modified siRNA Nos: 72 or 73 in Table A) in an acoustic trauma model is studied in chinchilla. The animals are exposed to an octave band of noise centered at 4 kHz for 2.5 h at 105 dB. The left ear of the noise-exposed chinchillas is pre-treated (48 h before the acoustic trauma) with 30 μg of either siRNA in ~10 μL of saline; the right ear is pre-treated with vehicle (saline). The compound action potential (CAP) is a convenient and reliable electrophysiological method for measuring the neural activity transmitted from the cochlea. The CAP is recorded by placing an electrode near the base of the cochlea in order to detect the local field potential that is generated when a sound stimulus, such as click or tone burst, is abruptly turned on. The functional status of each ear is assessed 2.5 weeks after the acoustic trauma. Specifically, the mean threshold of the compound action potential recorded from the round window is determined 2.5 weeks after the acoustic trauma in order to determine if the thresholds in the siRNA-treated ear are lower (better) than the untreated (saline) ear. In addition, the amount of inner and outer hair cell loss is determined in the siRNA-treated and the control ear. It is found that the thresholds in the siRNA-treated ear are lower than the untreated (saline) ear Also, the amount of hair cell loss is lower in the siRNA-treated ear than in the control ear.

Example 14

RTP801L siRNA Structures and Activity

In addition to Example 1 the siRNA compounds of the present invention are tested in the following model. The following negative controls were used:
a) Cy3-labeled synthetic stabilized siRNA against human, mouse and rat PTEN gene (PTEN-Cy3). Stock solution 20 mg/ml in double distilled.
b) Synthetic stabilized siRNA against GFP (GFP siRNA). Stock solution 20 mg/ml in double distilled.
The cells used in the experiment were 801 wt and Ko mouse embryonic fibroblasts (MEF) cells and 293T embryonic kidney cells.

The transfection reagent used was Lipofectamine™ 2000 (Invitrogen, Cat#11668-019).

Methods: $3 \times 10^5$ and $1 \times 10^5$ 801 wt MEF and 293T cells were seeded per well of the 6 wells plate, respectively. 24 h subsequently, cells were transfected with:
RTP801L siRNA molecules at final concentrations per well of 0.5-40 nM
GFP siRNA molecules at final concentrations per well of 0.5-40 nM
PTEN-Cy3 siRNA at final concentrations per well of 20-40 nM
Transfection mixture per each well contained 3 ul lipofectamine 2000 reagent (in 250 ul serum free medium).

RNA was extracted from cells 72 h following transfection. In the last 8 h of incubation, 500 uM $H_2O_2$ was added to wt MEF cells.

RNA was prepared from the cells and processed, and qPCR was performed for the evaluation of RTP801L mRNA levels, using mouse or human RTP801L-specific oligonucleotides and Cyclophylin as a reference gene.

TABLE A 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 1 | Hum | GCCAGUGUUCUAACAAACU | AGUUUGUUAGAACACUGGC | [2242-2260] | — | — | — | — |
| 2 | Hum | UAGCCAGUGUUCUAACAAA | UUUGUUAGAACACUGGCUA | [2240-2258] | — | — | — | — |
| 3 | Hum | GUGACUUCCUCACUCUAAU | AUUAGAGUGAGGAAGUCAC | [1385-1403] | — | — | — | — |
| 4 | Hum | AGCCAGUGUUCUAACAAAC | GUUUGUUAGAACACUGGCU | [2241-2259] | — | — | — | — |
| 5 | Hum | GAGUGAAUGAUGAAUACCU | AGGUAUUCAUCAUUCACUC | [1577-1595] | — | — | — | — |
| 6 | Hum | GACUUCCUCACUCUAAUGU | ACAUUAGAGUGAGGAAGUC | [1387-1405] | — | — | — | — |
| 7 | Hum | GUUCUAACAAACUAAACUC | GAGUUUAGUUUGUUAGAAC | [2248-2266] | — | — | [531-541] (11/11) | — |
| 8 | Hum | GAAUGAUGAAUACCUGUGA | UCACAGGUAUUCAUCAUUC | [1581-1599] | — | — | — | — |
| 9 | Hum | UCCUCACUCUAAUGUUUUA | UAAAACAUUAGAGUGAGGA | [1391-1409] | — | — | — | — |
| 10 | Hum, ms, rat, chimp | GCCAGAAUUUGGUUAAAAU | AUUUUAACCAAAUUCUGGC | [364-382] | [362-380] | [243-261] | [484-502] | — |
| 11 | Hum | ACGGGUCAAUUUACGAAGU | ACUUCGUAAAUUGACCCGU | [1809-1827] | — | — | — | — |
| 12 | Hum | UCCAUUGAGUGAAUGAUGA | UCAUCAUUCACUCAAUGGA | [1571-1589] | — | — | — | — |
| 13 | Hum | UUCCUCACUCUAAUGUUUU | AAAACAUUAGAGUGAGGAA | [1390-1408] | — | — | — | — |
| 14 | Hum | GCACCCAGAUUUUUCCAC | GUGGAAAAAUCUGGGUGC | [1901-1919] | — | — | — | — |
| 15 | Hum | GUGGUGCCAUUUCAGUAAC | GUUACUGAAAUGGCACCAC | [1428-1446] | — | — | — | — |
| 16 | Hum | CCUCACUCUAAUGUUUUAA | UUAAAACAUUAGAGUGAGG | [1392-1410] | — | — | — | — |
| 17 | Hum | CUUCCUCACUCUAAUGUUU | AAACAUUAGAGUGAGGAAG | [1389-1407] | — | — | — | — |
| 18 | Hum | GGCUUUUUUUCUCUAAGU | ACUUAGAGAAAAAAGCC | [1153-1171] | — | — | — | — |
| 19 | Hum | UCCAUUUUGUACAGAAU | AUUCUGUACAAAAUGGGA | [1005-1023] | — | — | — | — |
| 20 | Hum | GAGAAGUGAUUCAAAAUAG | CUAUUUUGAAUCACUUCUC | [967-985] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 21 | Hum | GGAGAAGUGAUUCAAAAUA | UAUUUUGAAUCACUUCUCC | [966-984] | — | — | — | — |
| 22 | Hum | GUCAGCUAAAGUCAUUUGU | ACAAAUGACUUUAGCUGAC | [841-859] | — | — | — | — |
| 23 | Hum, chimp | CCGGCCAGCAUUUCAGAAU | AUUCUGAAAUGCUGGCCGG | [237-255] | [235-251] (17/17) | [117-132] (16/16) | [357-375] | — |
| 24 | Hum, chimp, dog | AUGCUGGAGAACUGUCUGU | ACAGACAGUUCUCCAGCAU | [381-399] | [383-397] (15/15) | [264-278] (15/15) | [501-519] | [363-381] |
| 25 | Hum, chimp, dog | AAAUGCUGGAGAACUGUCU | AGACAGUUCUCCAGCAUUU | [379-397] | [377-395] (18/19) | [258-276] (18/19) | [499-517] | [361-379] |
| 26 | Hum, chimp | UGGUUAAAAUGCUGGAGAA | UUCUCCAGCAUUUUAACCA | [373-391] | [371-389] (18/19) | [252-270] (18/19) | [493-511] | [359-373] (15/15) |
| 27 | Hum, chimp | UUGGUUAAAAUGCUGGAGA | UCUCCAGCAUUUUAACCAA | [372-390] | [370-388] (18/19) | [251-269] (18/19) | [492-510] | [354-372] (18/19) |
| 28 | Hum | UAGCUCCACUUCACAUGCU | AGCAUGUGAAGUGGAGCUA | [2118-2136] | — | — | — | — |
| 29 | Hum | AGCCUCCACUCAACAAUGU | ACAUUGUUGAGUGGAGGCU | [2023-2041] | — | — | — | — |
| 30 | Hum | ACCCAGAUUUUUUCCACCU | AGGUGGAAAAAAUCUGGGU | [1903-1921] | — | — | — | — |
| 31 | Hum | UGCACCCAGAUUUUUUCCA | UGGAAAAAAUCUGGGUGCA | [1900-1918] | — | — | — | — |
| 32 | Hum | AAACGGGUCAAUUUACGAA | UUCGUAAAUUGACCCGUUU | [1807-1825] | — | — | — | — |
| 33 | Hum | AUGAUGAAUACCUGUGAGG | CCUCACAGGUAUUCAUCAU | [1583-1601] | — | — | — | — |
| 34 | Hum | UUGAGUGAAUGAUGAAUAC | GUAUUCAUCAUUCACUCAA | [1575-1593] | — | — | — | — |
| 35 | Hum | CGGCAAUAAUGGAACUGCU | AGCAGUUCCAUUAUUGCCG | [1353-1371] | — | — | — | — |
| 36 | Hum | GCCUAUCAAAACUUCCAAA | UUUGGAAGUUUUGAUAGGC | [1218-1236] | — | — | — | [1182-1194] (13/13) |
| 37 | Hum | UGGCUUUUUUUUCUCUAAG | CUUAGAGAAAAAAAGCCA | [1152-1170] | — | — | — | — |
| 38 | Hum | GCCCAUUUGAGUUUUACAU | AUGUAAAACUCAAAUGGGC | [1057-1075] | — | — | — | — |
| 39 | Hum, chimp | GGCCAGCAUUUCAGAAUUG | CAAUUCUGAAAUGCUGGCC | [239-257] | [237-251] (15/15) | [118-132] (15/15) | [359-377] | — |
| 40 | Hum, chimp | CGGCCAGCAUUUCAGAAUU | AAUUCUGAAAUGCUGGCCG | [238-256] | [236-251] (16/16) | [117-132] (16/16) | [358-376] | — |
| 41 | Hum | GCGUCGUACCUACUUUUGA | UCAAAAGUAGGUACGACGC | [589-607] | — | — | [711-727] (16/17) | — |
| 42 | Hum | UAGCGUCGUACCUACUUUU | AAAAGUAGGUACGACGCUA | [587-605] | — | — | — | — |
| 43 | Hum, rat, dog | AUGCACGUGAACUUGGAAA | UUUCCAAGUUCACGUGCAU | [525-543] | [523-539] (17/17) | [404-422] | [645-663] (18/19) | [507-525] |
| 44 | Hum | UUGUCCUUUUUCCACUAAC | GUUAGUGGAAAAAGGACAA | [2441-2459] | — | — | — | — |
| 45 | Hum | GUUGUCCUUUUUCCACUAA | UUAGUGGAAAAAGGACAAC | [2440-2458] | — | — | — | — |
| 46 | Hum | CUGUUGUCCUUUUUCCACU | AGUGGAAAAAGGACAACAG | [2438-2456] | — | — | — | — |
| 47 | Hum, chimp, dog | CUGGAGAACUGUCUGUCCA | UGGACAGACAGUUCUCCAG | [384-402] | [383-400] (18/18) | [264-281] (18/18) | [504-522] | [366-384] |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 48 | Hum | GCCAAUCUUUAUAGAAUUG | CAAUUCUAUAAAGAUUGGC | [2294-2312] | — | — | — | — |
| 49 | Hum | GUUCAAAUUAGCCAGUGUU | AACACUGGCUAAUUUGAAC | [2232-2250] | — | — | — | — |
| 50 | Hum, ms, rat, chimp | UGCCAGAAUUUGGUUAAAA | UUUUAACCAAAUUCUGGCA | [363-381] | [361-379] | [242-260] | [483-501] | — |
| 51 | Hum | CCCAGAUUUUUUCCACCUU | AAGGUGGAAAAAAUCUGGG | [1904-1922] | — | — | — | — |
| 52 | Hum | CACCCAGAUUUUUUCCACC | GGUGGAAAAAAUCUGGGUG | [1902-1920] | — | — | — | — |
| 53 | Hum | CAAUUUACGAAGUCUGCAU | AUGCAGACUUCGUAAAUUG | [1815-1833] | — | — | — | — |
| 54 | Hum | GGGUCAAUUUACGAAGUCU | AGACUUCGUAAAUUGACCC | [1811-1829] | — | — | — | — |
| 55 | Hum | AACGGGUCAAUUUACGAAG | CUUCGUAAAUUGACCCGUU | [1808-1826] | — | — | — | — |
| 56 | Hum | UGAAACGGGUCAAUUUACG | CGUAAAUUGACCCGUUUCA | [1805-1823] | — | — | — | — |
| 57 | Hum | UGGUGCCAUUUCAGUAACC | GGUUACUGAAAUGGCACCA | [1429-1447] | — | — | — | — |
| 58 | Hum | UGGAACUGCUUCACUGUUU | AAACAGUGAAGCAGUUCCA | [1362-1380] | — | — | — | [1333-1343] (11/11) |
| 59 | Hum | AAGGUAGGAUUAAGUAGGU | ACCACUUAAUCCUACCUU | [1286-1304] | — | — | — | — |
| 60 | Hum | CAGGAAGGUAGGAUUAAGU | ACUUAAUCCUACCUUCCUG | [1282-1300] | — | — | — | — |
| 61 | Hum | AGCCUAUCAAAACUUCCAA | UUGGAAGUUUUGAUAGGCU | [1217-135] | — | — | — | [1182-1194] (13/13) |
| 62 | Hum | AACCAGAUUUGCCUAUUUU | AAAAUAGGCAAAUCUGGUU | [1123-1141] | — | — | — | — |
| 63 | Hum | GUACAGAAUUGAAUGGGAU | AUCCCAUUCAAUUCUGUAC | [1015-1033] | — | — | — | — |
| 64 | Hum | AUCCCAUUUUUGUACAGAA | UUCUGUACAAAAAUGGGAU | [1004-1022] | — | — | — | — |
| 65 | Hum | CAGCUAAAGUCAUUUGUAG | CUACAAAUGACUUUAGCUG | [843-861] | [845-856] (12/12) | — | — | [834-844] (11/11) |
| 66 | Hum | AUGAUUGGGUAGUAAAACU | AGUUUUACUACCCAAUCAU | [813-831] | — | — | — | — |
| 67 | Hum | AGGGUCCUAAAAAGGGAAA | UUUCCCUUUUUAGGACCCU | [776-794] | — | — | — | — |
| 68 | Hum, rat, dog | ACGUGAACUUGGAAAUUGA | UCAAUUUCCAAGUUCACGU | [529-547] | [527-545] (18/19) | [408-426] | [651-667] (17/17) | [511-529] |
| 69 | Hum, ms, chimp | GAAUUGCUCAAGAUGUCCU | AGGACAUCUUGAGCAAUUC | [463-481] | [461-479] | [342-360] | [583-601] | [447-463] (17/17) |
| 70 | Hum, ms, chimp | GAGAAUUGCUCAAGAUGUC | GACAUCUUGAGCAAUUCUC | [461-479] | [459-477] | — | [581-599] | [447-461] (15/15) |
| 71 | Hum, ms, chimp | AGAGAAUUGCUCAAGAUGU | ACAUCUUGAGCAAUUCUCU | [460-478] | [458-476] | — | [580-598] | [442-460] (18/19) |
| 72 | Hum, ms, chimp | CCAGAGAAUUGCUCAAGAU | AUCUUGAGCAAUUCUCUGG | [458-476] | [456-474] | [337-355] | [578-596] | [440-458] (18/19) |
| 73 | Hum, ms, chimp | CCCAGAGAAUUGCUCAAGA | UCUUGAGCAAUUCUCUGGG | [457-475] | [455-473] | [336-354] | [577-595] | [439-457] (18/19) |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 74 | Hum, chimp, dog | AACUGUCUGUCCAAAUCAA | UUGAUUUGGACAGACAGUU | [390-408] | [388-406] (18/19) | [269-287] (18/19) | [510-528] | [372-390] |
| 75 | Hum | UGUCCUUUUUCCACUAACA | UGUUAGUGGAAAAAGGACA | [2442-2460] | — | — | — | — |
| 76 | Hum | GAACUGUUGUCCUUUUUCC | GGAAAAGGACAACAGUUC | [2435-2453] | — | — | — | — |
| 77 | Hum, chimp, dog | GGAGAACUGUCUGUCCAAA | UUUGGACAGACAGUUCUCC | [366-404] | [384-400] (17/17) | [265-282] (18/18) | [506-524] | [368-386] |
| 78 | Hum | CAGUGUUCUAACAAACUAA | UUAGUUUGUUAGAACACUG | [2244-2262] | — | — | — | — |
| 79 | Hum | AAAUUAGCCAGUGUUCUAA | UUAGAACACUGGCUAAUUU | [2236-2254] | — | — | — | — |
| 80 | Hum | GACCUAAAAUGUCACUGUU | AACAGUGACAUUUUAGGUC | [2216-2234] | — | — | — | — |
| 81 | Hum, chimp | UUGCCAGAAUUUGGUUAAA | UUUAACCAAAUUCUGGCAA | [362-380] | [361-378] (18/18) | [242-259] (18/18) | [482-500] | — |
| 82 | Hum | UGGAUAAGGAGCUUAUUCA | UGAAUAAGCUCCUUAUCCA | [2080-2096] | — | — | — | — |
| 83 | Hum | AGCAAGGCUUUCAUAUCCU | AGGAUAUGAAAGCCUUGCU | [2049-2067] | — | — | — | — |
| 84 | Hum | CUCCACUCAACAAUGUUCA | UGAACAUUGUUGAGUGGAG | [2026-2044] | — | — | — | — |
| 85 | Hum | UUAGCCUCCACUCAACAAU | AUUGUUGAGUGGAGGCUAA | [2021-2039] | — | — | — | — |
| 86 | Hum | AGAGAAUUUAGCCUCCACU | AGUGGAGGCUAAAUUCUCU | [2014-2032] | — | — | — | — |
| 87 | Hum | AGAUCAUUAUCUCUUUCCU | AGGAAAGAGAUAAUGAUCU | [1981-1999] | — | — | — | — |
| 88 | Hum | GGCCUUAUUUUUGUCUUA | UAAGACAAAAAUAAGGCC | [1950-1968] | — | — | — | — |
| 89 | Hum | CAGAUUUUUCCACCUUGG | CCAAGGUGGAAAAAUCUG | [1906-1924] | — | — | — | — |
| 90 | Hum | CCAGAUUUUUCCACCUUG | CAAGGUGGAAAAAUCUGG | [1905-1923] | — | — | — | — |
| 91 | Hum | GCCUAGAGAAUGAAACUCA | UGAGUUUCAUUCUCUAGGC | [1862-1880] | — | — | — | — |
| 92 | Hum | UACGAAGUCUGCAUUGGCU | AGCCAAUGCAGACUUCGUA | [1820-1838] | — | — | — | — |
| 93 | Hum | CGGGUCAAUUUACGAAGGC | GACUUCGUAAAUUGACCCG | [1810-1828] | — | — | — | — |
| 94 | Hum | GAAACGGGUCAAUUUACGA | UCGUAAAUUGACCCGUUUC | [1806-1824] | — | — | — | — |
| 95 | Hum | GUCCCUCUCUGAUUCACUU | AAGUGAAUCAGAGAGGGAC | [1626-1644] | [1278-1288] (11/11) | — | — | — |
| 96 | Hum | GAGAGGGACUCCUAAGAA | UUCUUAGGAGUCCCCUCUC | [78-96] | — | — | — | — |
| 97 | Hum | GAAGGUAGGAUUAAGUAGG | CCUACUUAAUCCUACCUUC | [1285-1303] | — | — | — | — |
| 98 | Hum | UAGCCUAUCAAAACUUCCA | UGGAAGUUUUGAUAGGCUA | [1216-1234] | — | — | — | [1182-1194] (13/13) |
| 99 | Hum | CCAUUUUUGUACAGAAUUG | CAAUUCUGUACAAAAAUGG | [1007-1025] | — | — | — | — |
| 100 | Hum | UAGAUCCCAUUUUUGUACA | UGUACAAAAAUGGGAUCUA | [1001-1019] | — | — | — | — |
| 101 | Hum | GCAGCUAACAGGCUGAUUU | AAAUCAGCCUGUUAGCUGC | [937-955] | — | — | — | — |
| 102 | Hum | GUGUUUCACAUUCAUAGCA | UGCUAUGAAUGUGAAACAC | [915-933] | — | — | — | — |
| 103 | Hum | GUCCUAAAAGGGAAAAUA | UAUUUUCCCUUUUAGGAC | [779-797] | — | — | — | — |
| 104 | Hum | GGGUCCUAAAAGGGAAAA | UUUUCCCUUUUAGGACCC | [777-795] | — | — | — | — |
| 105 | Hum | AAGGGUCCUAAAAGGGAA | UUCCCUUUUAGGACCCUU | [775-793] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 106 | Hum | CAGGGACUUUUUCUUUAGU | ACUAAAGAAAAAGUCCCUG | [653-671] | — | — | [773-789] (17/17) | — |
| 107 | Hum, rat, dog | UGCACGUGAACUUGGAAAU | AUUUCCAAGUUCACGUGCA | [526-544] | [524-539] (16/16) | [405-423] | [646-664] (18/19) | [508-526] |
| 108 | Hum, ms, rat, dog | GUGUUAUGCACGUGAACUU | AAGUUCACGUGCAUAACAC | [520-538] | [518-536] | [399-417] | — | [502-520] |
| 109 | Hum, ms | GUUGUGUUAUGCACGUGAA | UUCACGUGCAUAACACAAC | [517-535] | [515-533] | [398-414] (17/17) | [637-655] (18/19) | [501-517] (17/17) |
| 110 | Hum | GAGGUUGUGUUAUGCACGU | ACGUGCAUAACACAACCUC | [514-532] | [514-530] (17/17) | [398-411] (14/14) | [634-649] (16/16) | [496-514] (18/19) |
| 111 | Hum, ms, chimp | GACCCAGAGAAUUGCUCAA | UUGAGCAAUUCUCUGGGUC | [455-473] | [453-471] | [334-348] (15/15) | [575-593] | — |
| 112 | Hum, chimp | AAGCAAACUAAACUUGGUU | AACCAAGUUUAGUUUGCUU | [408-426] | — | — | [528-546] | — |
| 113 | Hum, chimp | CCAAAUCAAAGCAAACUAA | UUAGUUUGCUUUGAUUUGG | [400-418] | [402-413] (12/12) | [279-294] (15/16) | [520-538] | [382-397] (16/16) |
| 114 | Hum | GGAAGGCUGUUAAAUUAAU | AUUAAUUUAACAGCCUUCC | [2512-2530] | — | — | — | — |
| 115 | Hum | UGCCUGUUAUGCUUACAAA | UUUGUAAGCAUAACAGGCA | [2478-2496] | — | — | — | — |
| 116 | Hum | UUGCCUGUUAUGCUUACAA | UUGUAAGCAUAACAGGCAA | [2477-2495] | — | — | — | — |
| 117 | Hum | UGACUCUCUUGCCUGUUAU | AUAACAGGCAAGAGAGUCA | [2469-2487] | — | — | — | — |
| 118 | Hum | GUCCUUUUUCCACUAACAG | CUGUUAGUGGAAAAGGAC | [2443-2461] | — | — | — | — |
| 119 | Hum | UAGAACUGUUGUCCUUUUU | AAAAGGACAACAGUUCUA | [2433-2451] | — | — | — | — |
| 120 | Hum | GUAGAACUGUUGUCCUUUU | AAAAGGACAACAGUUCUAC | [2432-2450] | — | — | — | — |
| 121 | Hum, chimp, dog | GAGAACUGUCUGUCCAAAU | AUUUGGACAGACAGUUCUC | [387-405] | [385-400] (16/16) | [266-282] (17/17) | [507-525] | [369-387] |
| 122 | Hum | GCCAAGAUAAAUCAAUGUU | AACAUUGAUUUAUCUUGGC | [2314-2332] | — | — | — | — |
| 123 | Hum | ACAAAGCCAAUCUUUAUAG | CUAUAAAGAUUGGCUUUGU | [2289-2307] | — | — | — | — |
| 124 | Hum | AUGUCACUGUUCAAAUUAG | CUAAUUUGAACAGUGACAU | [2224-2242] | — | — | — | — |
| 125 | Hum | GUGAUCCUGUUACUGAUAC | GUAUCAGUAACAGGAUCAC | [2190-2208] | — | — | — | — |
| 126 | Hum, chimp | GAAUUGGUUAAAAUGCUG | CAGCAUUUUAACCAAUUC | [368-386] | [366-381] (16/16) | [247-262] (16/16) | [488-506] | — |
| 127 | Hum | AGGCUUUCAUAUCCUUGCU | AGCAAGGAUAUGAAAGCCU | [2053-2071] | — | — | — | — |
| 128 | Hum | CAGCAAGGCUUUCAUAUCC | GGAUAUGAAAGCCUUGCUG | [2048-2066] | — | — | — | — |
| 129 | Hum | GCCUCCACUCAACAAUGUU | AACAUUGUUGAGUGGAGGC | [2024-2042] | — | — | — | — |
| 130 | Hum | GAAUUUAGCCUCCACUCAA | UUGAGUGGAGGCUAAAUUC | [2017-2035] | — | — | — | — |
| 131 | Hum | GAGAGAAUUUAGCCUCCAC | GUGGAGGCUAAAUUCUCUC | [2013-2031] | — | — | — | — |
| 132 | Hum | UAGAUCAUUAUCUCUUUCC | GGAAAGAGAUAAUGAUCUA | [1980-1998] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 133 | Hum | AGGCCUUAUUUUUUGUCUU | AAGACAAAAAAUAAGGCCU | [1949-1967] | — | — | — | — |
| 134 | Hum | AAGGCCUUAUUUUUUGUCU | AGACAAAAAAUAAGGCCUU | [1948-1966] | — | — | — | — |
| 135 | Hum | GCAUGCACCCAGAUUUUUU | AAAAAAUCUGGGUGCAUGC | [1897-1915] | — | — | — | — |
| 136 | Hum | GGUCAAUUUACGAAGUCUG | CAGACUUCGUAAAUUGACC | [1812-1830] | — | — | — | — |
| 137 | Hum | GGGCUUUUCUGGGAAUUGA | UCAAUUCCCAGAAAAGCCC | [1725-1743] | — | — | — | — |
| 138 | Hum | AUACCUGUGAGGAUAGGAA | UUCCUAUCCUCACAGGUAU | [1590-1608] | — | — | — | — |
| 139 | Hum | ACUCUUCCAUUGAGUGAAU | AUUCACUCAAUGGAAGAGU | [1566-1584] | — | — | — | — |
| 140 | Hum, chimp | GGGAUUAUGUUGUUCCUGA | UCAGGAACAACAUAAUCCC | [307-325] | [305-323] (18/19) | — | [427-445] | — |
| 141 | Hum | UGCCAUUUCAGUAACCACG | CGUGGUUACUGAAAUGGCA | [1432-1450] | — | — | — | — |
| 142 | Hum | UGUGGUGCCAUUUCAGUAA | UUACUGAAAUGGCACCACA | [1427-1445] | — | — | — | — |
| 143 | Hum | AGCUUGUGGUGCCAUUUCA | UGAAAUGGCACCACAAGCU | [1423-1441] | — | — | — | — |
| 144 | Hum | CUCUAAUGUUUUAAAGAGG | CCUCUUUAAAACAUUAGAG | [1397-1415] | — | — | — | — |
| 145 | Hum | GAACUGCUUCACUGUUUCU | AGAAACAGUGAAGCAGUUC | [1364-1382] | — | — | — | [1333-1345] (13/13) |
| 146 | Hum | GGAACUGCUUCACUGUUUC | GAAACAGUGAAGCAGUUCC | [1363-1381] | — | — | — | [1333-1344] (12/12) |
| 147 | Hum | ACGGCAAUAAUGGAACUGC | GCAGUUCCAUUAUUGCCGU | [1352-1370] | — | — | — | — |
| 148 | Hum | ACCCUAGGUAAGAGUAAAU | AUUUACUCUUACCUAGGGU | [1323-1341] | — | — | — | — |
| 149 | Hum | CUCUAAGUUUUCAGAGGAU | AUCCUCUGAAAACUUAGAG | [1164-1182] | — | — | — | — |
| 150 | Hum | GCUUGGUAAUAGACUAUAU | AUAUAGUCUAUUACCAAGC | [1103-1121] | — | — | — | — |
| 151 | Hum | AGGCUUGGUAAUAGACUAU | AUAGUCUAUUACCAAGCCU | [1101-1119] | — | — | — | — |
| 152 | Hum | GAGUUUUACAUUUGAUUCC | GGAAUCAAAUGUAAAACUC | [1065-1083] | — | — | — | — |
| 153 | Hum | GAAGCCCAUUUGAGUUUUA | UAAAACUCAAAUGGGCUUC | [1054-1072] | — | — | — | — |
| 154 | Hum, chimp | GAGCCUGCUAAGUGAUUUU | AAAAUCACUUAGCAGGCUC | [281-299] | [283-296] (14/14) | [164-177] (14/14) | [401-419] | [263-281] (18/19) |
| 155 | Hum | UGUACAGAAUUGAAUGGGA | UCCCAUUCAAUUCUGUACA | [1014-1032] | — | — | — | — |
| 156 | Hum | UUGUACAGAAUUGAAUGGG | CCCAUUCAAUUCUGUACAA | [1013-1031] | — | — | — | — |
| 157 | Hum | GUGAUUCAAAAUAGUGUAG | CUACACUAUUUUGAAUCAC | [972-990] | — | — | — | — |
| 158 | Hum | UUGGAGAAGUGAUUCAAAA | UUUUGAAUCACUUCUCCAA | [964-982] | — | — | — | — |
| 159 | Hum | CAGGCUGAUUUUCUGGCCU | AGGCCAGAAAAUCAGCCUG | [945-963] | [939-949] (11/11) | — | — | — |
| 160 | Hum | GCUAACAGGCUGAUUUUCU | AGAAAAUCAGCCUGUUAGC | [940-958] | [939-949] (11/11) | — | — | — |
| 161 | Hum | GCUAAAGUCAUUUGUAGUU | AACUACAAAUGACUUUAGC | [845-863] | [845-858] (14/14) | — | — | [834-845] (12/12) |
| 162 | Hum | UAGUCAGCUAAAGUCAUUU | AAAUGACUUUAGCUGACUA | [839-857] | — | — | — | — |
| 163 | Hum | CUAGUCAGCUAAAGUCAUU | AAUGACUUUAGCUGACUAG | [838-856] | — | — | — | — |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 164 | Hum | UGAUUGGGUAGUAAAACUA | UAGUUUUACUACCCAAUCA | [814-832] | — | — | — | — |
| 165 | Hum, chimp | GCAUUCAGAAUUGCUGGA | UCCAGCAAUUCUGAAAUGC | [244-262] | — | — | [364-382] | — |
| 166 | Hum | GAAGGUCCUAAAAAGGGA | UCCCUUUUAGGACCUUC | [774-792] | — | — | — | — |
| 167 | Hum | GGUUUCAGGAGAACUCUGA | UCAGAGUUCUCCUGAAACC | [690-708] | — | — | — | — |
| 168 | Hum | UCCUCUGGUUUCAGGAGAA | UUCUCCUGAAACCAGAGGA | [684-702] | — | — | — | — |
| 169 | Hum | AGGGACUUUUUCUUUAGUA | UACUAAAGAAAAGUCCCU | [654-672] | — | — | [774-789] (16/16) | — |
| 170 | Hum, chimp | CUACUUUUGAGCUUACACU | AGUGUAAGCUCAAAAGUAG | [598-616] | — | — | [718-736] | — |
| 171 | Hum | CUAGCGUCGUACCUACUUU | AAAGUAGGUACGACGCUAG | [586-604] | — | — | — | — |
| 172 | Hum, ms, rat, chimp | GUAAAAGCUGGAUAGGAU | AUCCUAUCCAGCUUUUUAC | [556-574] | [554-572] | [435-453] | [676-694] | [538-552] (15/15) |
| 173 | Hum, ms, rat, dog | UUAUGCACGUGAACUUGGA | UCCAAGUUCACGUGCAUAA | [523-541] | [521-539] | [402-420] | [643-661] (18/19) | [505-523] |
| 174 | Hum, ms | GGUUGUGUUAUGCACGUGA | UCACGUGCAUAACACAACC | [516-534] | [514-532] | [398-413] (16/16) | [636-654] (18/19) | [501-516] (16/16) |
| 175 | Hum | GCGAGGUUGUGUUAUGCAC | GUGCAUAACACAACCUCGC | [512-530] | [514-528] (15/15) | [398-409] (12/12) | [632-649] (18/18) | [494-512] (18/19) |
| 176 | Hum, chimp | AAAGCAAACUAAACUUGGU | ACCAAGUUUAGUUUGCUUU | [407-425] | — | — | [527-545] | — |
| 177 | Hum | CUGUUAUGCUUACAAAAUG | CAUUUUGUAAGCAUAACAG | [2481-2499] | — | — | — | — |
| 178 | Hum | UCCUUUUUCCACUAACAGU | ACUGUUAGUGGAAAAAGGA | [2444-2462] | — | — | — | — |
| 179 | Hum | CAAUCUUUAUAGAAUUGGG | CCCAAUUCUAUAAAGAUUG | [2296-2314] | — | — | — | — |
| 180 | Hum | CCAAUCUUUAUAGAAUUGG | CCAAUUCUAUAAAGAUUGG | [2295-2313] | — | — | — | — |
| 181 | Hum | AUACUACAAAGCCAAUCUU | AAGAUUGGCUUUGUAGUAU | [2284-2302] | [1571-1581] (11/11) | — | — | — |
| 182 | Hum | CCAGUGUUCUAACAAACUA | UAGUUUGUUAGAACACUGG | [2243-2261] | — | — | — | — |
| 183 | Hum | ACUGUUCAAAUUAGCCAGU | ACUGGCUAAUUUGAACAGU | [2229-2247] | — | — | — | — |
| 184 | Hum | CCUAAAAUGUCACUGUUCA | UGAACAGUGACAUUUUAGG | [2218-2236] | — | — | — | — |
| 185 | Hum | UGACCUAAAAUGUCACUGU | ACAGUGACAUUUUAGGUCA | [2215-2233] | — | — | — | — |
| 186 | Hum | UAAGUGACCUAAAAUGUCA | UGACAUUUUAGGUCACUUA | [2211-2229] | — | — | — | — |
| 187 | Hum | CUAUAAGUGACCUAAAAUG | CAUUUUAGGUCACUUAUAG | [2208-2226] | — | — | — | — |
| 188 | Hum | GUGUGAUCCUGUUACUGAU | AUCAGUAACAGGAUCACAC | [2188-2206] | — | — | — | — |
| 189 | Hum | CCACUUCACAUGCUGGAGA | UCUCCAGCAUGUGAAGUGG | [2123-2141] | — | — | — | — |
| 190 | Hum | GGCUUUCAUAUCCUUGCUG | CAGCAAGGAUAUGAAAGCC | [2054-2072] | — | — | — | — |
| 191 | Hum | GCAAGGCUUUCAUAUCCUU | AAGGAUAUGAAAGCCUUGC | [2050-2068] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 192 | Hum | CACUCAACAAUGUUCAAUU | AAUUGAACAUUGUUGAGUG | [2029-2047] | — | — | — | — |
| 193 | Hum | UAGCCUCCACUCAACAAUG | CAUUGUUGAGUGGAGGCUA | [2022-2040] | — | — | — | — |
| 194 | Hum | GUAGAUCAUUAUCUCUUUC | GAAAGAGAUAAUGAUCUAC | [1979-1997] | — | — | — | — |
| 195 | Hum | CCACCUUGGAUACCUGUCA | UGACAGGUAUCCAAGGUGG | [1916-1934] | — | — | — | — |
| 196 | Hum | AUGCAUGCACCCAGAUUUU | AAAAUCGGGUGCAUGCAU | [1895-1913] | — | — | — | — |
| 197 | Hum | UUGAAACGGGUCAAUUUAC | GUAAAUUGACCCGUUUCAA | [1804-1822] | — | — | — | — |
| 198 | Hum, chimp | UCAACGAGGUAAUAUUUGA | UCAAAUAUUACCUCGUUGA | [334-352] | — | — | [454-472] | — |
| 199 | Hum, chimp | ACCUCAACGAGGUAAUAUU | AAUAUUACCUCGUUGAGGU | [331-349] | [329-341] (13/13) | [210-222] (13/13) | [451-469] | — |
| 200 | Hum, chimp | CCAACCUCAACGAGGUAAU | AUUACCUCGUUGAGGUUGG | [328-346] | [326-341] (16/16) | [207-222] (16/16) | [448-466] | — |
| 201 | Hum | GUGCUUAAUCUCAGAUGAA | UUCAUCUGAGAUUAAGCAC | [1674-1692] | — | — | — | — |
| 202 | Hum | CUAGUCCCUCUCUGAUUCA | UGAAUCAGAGAGGGACUAG | [1623-1641] | [1278-1288] (11/11) | — | — | — |
| 203 | Hum | AUGAAUACCUGUGAGGAUA | UAUCCUCACAGGUAUUCAU | [1586-1604] | — | — | — | — |
| 204 | Hum | AGAGGGGACUCCUAAGAAG | CUUCUUAGGAGUCCCCUCU | [79-97] | — | — | — | — |
| 205 | Hum | GAUUACUCUUCCAUUGAGU | ACUCAAUGGAAGAGUAAUC | [1562-1580] | — | — | — | — |
| 206 | Hum | UGAUUACUCUUCCAUUGAG | CUCAAUGGAAGAGUAAUCA | [1561-1579] | — | — | — | — |
| 207 | Hum | UAGUUGAUUACUCUUCCAU | AUGGAAGAGUAAUCAACUA | [1557-1575] | — | — | — | — |
| 208 | Hum | GUAGUUGAUUACUCUUCCA | UGGAAGAGUAAUCAACUAC | [1556-1574] | — | — | — | — |
| 209 | Hum | GUGUUGAAUACUGUCUUUA | UAAAGACAGUAUUCAACAC | [1497-1515] | — | — | — | — |
| 210 | Hum | AAGCUCAGUUUCCCCUGUU | AACAGGGGAAACUGAGCUU | [1473-1491] | — | — | — | — |
| 211 | Hum | ACCACGGUGUUGUUUUAGA | UCUAAAACAACACCGUGGU | [1445-1463] | — | — | — | — |
| 212 | Hum | GUGCCAUUUCAGUAACCAC | GUGGUUACUGAAAUGGCAC | [1431-1449] | — | — | — | — |
| 213 | Hum | GGUGCCAUUUCAGUAACCA | UGGUUACUGAAAUGGCACC | [1430-1448] | — | — | — | — |
| 214 | Hum | CUGCUUCACUGUUUCUUGG | CCAAGAAACAGUGAAGCAG | [1367-1385] | — | — | — | [1333-1346] (14/14) |
| 215 | Hum | AACUGCUUCACUGUUUCUU | AAGAAACAGUGAAGCAGUU | [1365-1383] | — | — | — | [1333-1346] (14/14) |
| 216 | Hum | CAAUAAUGGAACUGCUUCA | UGAAGCAGUUCCAUUAUUG | [1356-1374] | — | — | — | — |
| 217 | Hum | AGGUAAGAGUAAAUGAGAA | UUCUCAUUUACUCUUACCU | [1328-1346] | — | — | — | — |
| 218 | Hum | GGAUUAAGUAGGUGAGUUU | AAACUCACCUACUUAAUCC | [1292-1310] | — | — | — | — |
| 219 | Hum | GACUCAAAUUUGAAGGGUU | AACCCUUCAAAUUUGAGUC | [1257-1275] | — | — | — | — |
| 220 | Hum | CAGAUUUGCCUAUUUUGAU | AUCAAAAUAGGCAAAUCUG | [1126-1144] | — | — | — | — |
| 221 | Hum | CCAGAUUUGCCUAUUUUGA | UCAAAAUAGGCAAAUCUGG | [1125-1143] | — | — | — | — |
| 222 | Hum | AUAUAAACCAGAUUUGCCU | AGGCAAAUCUGGUUUAUAU | [1118-1136] | — | — | — | — |
| 223 | Hum | GGCUUGGUAAUAGACUAUA | UAUAGUCUAUUACCAAGCC | [1102-1120] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 224 | Hum | UUCCACAAUUUGGUUUCAG | CUGAAACCAAAUUGUGGAA | [1080-1098] | — | — | — | — |
| 225 | Hum | UUUGAUUCCACAAUUUGGU | ACCAAAUUGUGGAAUCAAA | [1075-1093] | — | — | — | — |
| 226 | Hum | GGAAUAGGUAAGCAAAAGU | ACUUUUGCUUACCUAUUCC | [1034-1052] | — | — | — | — |
| 227 | Hum | CAGAAUUGAAUGGGAUGGA | UCCAUCCCAUUCAAUUCUG | [1018-1036] | — | — | — | — |
| 228 | Hum | GAUCCCAUUUUGUACAGA | UCUGUACAAAAUGGGAUC | [1003-1021] | — | — | — | — |
| 229 | Hum | AGAUCCCAUUUUGUACAG | CUGUACAAAAUGGGAUCU | [1002-1020] | — | — | — | — |
| 230 | Hum | GUGUAGAUUUCUGCAUAG | CUAUGCAGAAAUCUACAC | [985-1003] | — | — | — | — |
| 231 | Hum | AGGCUGAUUUUCUGGCCUU | AAGGCCAGAAAAUCAGCCU | [946-964] | [939-949] (11/11) | — | — | — |
| 232 | Hum | CACAUUCAUAGCAACUGCA | UGCAGUUGCUAUGAAUGUG | [921-939] | — | — | — | — |
| 233 | Hum | CCCCACCUGCCCUAAAUAA | UUAUUUAGGGCAGGUGGGG | [866-884] | — | — | — | — |
| 234 | Hum | AGCUAAAGUCAUUUGUAGU | ACUACAAAUGACUUUAGCU | [844-862] | [845-857] (13/13) | — | — | [834-845] (12/12) |
| 235 | Hum | UCAGCUAAAGUCAUUUGUA | UACAAAUGACUUUAGCUGA | [842-860] | [845-855] (11/11) | — | — | — |
| 236 | Hum | CAGCUAGUCAGCUAAAGUC | GACUUUAGCUGACUAGCUG | [835-853] | — | — | — | — |
| 237 | Hum | UGGGUAGUAAAACUAUUCA | UGAAUAGUUUUACUACCCA | [818-836] | — | — | — | — |
| 238 | Hum | GAUUAUUUCAUGAUUGGGU | ACCCAAUCAUGAAAUAAUC | [804-822] | — | — | — | — |
| 239 | Hum | GGUCCUAAAAAGGGAAAAU | AUUUUCCCUUUUUAGGACC | [778-796] | — | — | — | — |
| 240 | Hum, chimp | CAGCAUUUCAGAAUUGCUG | CAGCAAUUCUGAAAUGCUG | [242-260] | [240-251] (12/12) | [121-139] (18/19) | [362-380] | — |
| 241 | Hum, chimp | GCCAGCAUUUCAGAAUUGC | GCAAUUCUGAAAUGCUGGC | [240-258] | [38-251] (14/14) | [119-137] (18/19) | [360-378] | — |
| 242 | Hum | AGAACUCUGAUCCUCAGCU | AGCUGAGGAUCAGAGUUCU | [699-717] | — | [579-596] (18/18) | — | — |
| 243 | Hum | UAAGAAGCCACCUGCCUGU | ACAGGCAGGUGGCUUCUUA | [91-109] | — | — | — | — |
| 244 | Hum | CUCCUCUGGUUUCAGGAGA | UCUCCUGAAACCAGAGGAG | [683-701] | — | — | — | — |
| 245 | Hum | GGGACUUUUUCUUUAGUAG | CUACUAAAGAAAAGUCCC | [655-673] | — | — | [775-789] (15/15) | — |
| 246 | Hum, chimp | AGCUUACACUUGUGUUUAA | UUAAACACAAGUGUAAGCU | [607-625] | [613-623] (11/11) | — | [727-745] | [589-607] (18/19) |
| 247 | Hum | GUCGUACCUACUUUUGAGC | GCUCAAAAGUAGGUACGAC | [591-609] | — | — | [711-729] (18/19) | — |
| 248 | Hum | AGCGUCGUACCUACUUUUG | CAAAAGUAGGUACGACGCU | [588-606] | — | — | — | — |
| 249 | Hum, rat, chimp | AAGCUGGAUAGGAUUGUGU | ACACAAUCCUAUCCAGCUU | [561-579] | [559-577] (18/19) | [440-458] | [681-699] | — |
| 250 | Hum, chimp | UUGCGAGGUUGUGUUAUGC | GCAUAACACAACCUCGCAA | [510-528] | [514-526] (13/13) | — | [630-648] | — |
| 251 | Hum, ms, | UUGCUCAAGAUGUCCUGCG | CGCAGGACAUCUUGAGCAA | [466-484] | [464-482] | [345-363] (18/19) | [586-604] | [448-466] |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| | chimp, dog | | | | | | | |
| 252 | Hum, ms, chimp | ACCCAGAGAAUUGCUCAAG | CUUGAGCAAUUCUCUGGGU | [456-474] | [454-472] (18/19) | [335-353] | [576-594] | — |
| 253 | Hum, chimp | UCAAAGCAAACUAAACUUG | CAAGUUUAGUUUGCUUUGA | [405-423] | [403-421] (18/19) | [284-300] (16/17) | [525-543] | [387-397] (11/11) |
| 254 | Hum, chimp | UCCAAAUCAAAGCAAACUA | UAGUUUGCUUUGAUUUGGA | [399-417] | [397-413] (16/17) | [278-294] (16/17) | [519-537] | [381-397] (17/17) |
| 255 | Hum | AUGGAAGGCUGUUAAAUUA | UAAUUUAACAGCCUUCCAU | [2510-2528] | — | — | — | — |
| 256 | Hum, chimp, dog | CUGUCCAAAUCAAAGCAAA | UUUGCUUUGAUUUGGACAG | [396-414] | [394-412] (18/19) | — | [516-534] | [378-396] |
| 257 | Hum, chimp, dog | GUCUGUCCAAAUCAAAGCA | UGCUUUGAUUUGGACAGAC | [394-412] | — | — | [514-532] | [376-394] |
| 258 | Hum | GUUAUGCUUACAAAAUGGU | ACCAUUUUGUAAGCAUAAC | [2483-2501] | — | — | — | — |
| 259 | Hum | UUGACUCUCUUGCCUGUUA | UAACAGGCAAGAGAGUCAA | [2468-2486] | — | — | — | — |
| 260 | Hum | CCUUUUUCCACUAACAGUU | AACUGUUAGUGGAAAAAGG | [2445-2463] | — | — | — | — |
| 261 | Hum, chimp, dog | GAACUGUCUGUCCAAAUCA | UGAUUUGGACAGACAGUUC | [389-407] | [387-405] (18/19) | [268-282] (15/15) | [509-527] | [371-389] |
| 262 | Hum | UGGGCAUCGAUGUAGAACU | AGUUCUACAUCGAUGCCCA | [2421-2439] | — | — | — | — |
| 263 | Hum | AAAGGUUCACUGUGUUUCU | AGAAACACAGUGAACCUUU | [2359-2377] | — | — | — | — |
| 264 | Hum | UCCAAAGGUUCACUGUGUU | AACACAGUGAACCUUUGGA | [2356-2374] | — | — | — | — |
| 265 | Hum | GCAUGUCUAUUGUUAAGCU | AGCUUAACAAUAGACAUGC | [2338-2356] | — | — | — | — |
| 266 | Hum | UCAAUGUUGUUUUGCAUGU | ACAUGCAAAACAACAUUGA | [2325-2343] | — | — | — | — |
| 267 | Hum | UUGGGCCAAGAUAAAUCAA | UUGAUUUAUCUUGGCCCAA | [2310-2328] | — | — | — | — |
| 268 | Hum | AUUGGGCCAAGAUAAAUCA | UGAUUUAUCUUGGCCCAAU | [2309-2327] | — | — | — | — |
| 269 | Hum | CAAAGCCAAUCUUUAUAGA | UCUAUAAAGAUUGGCUUUG | [2290-2308] | — | — | — | — |
| 270 | Hum | CUACAAAGCCAAUCUUUAU | AUAAAGAUUGGCUUUGUAG | [2287-2305] | — | — | — | — |
| 271 | Hum | ACUAAACUCUUCAAAUGCU | AGCAUUUGAAGAGUUUAGU | [2258-2276] | — | — | — | — |
| 272 | Hum | GUGUUCUAACAAACUAAAC | GUUUAGUUUGUUAGAACAC | [2246-2264] | — | — | — | — |
| 273 | Hum | UCACUGUUCAAAUUAGCCA | UGGCUAAUUUGAACAGUGA | [2227-2245] | — | — | — | — |
| 274 | Hum | CUGUUACUGAUACUAUAAG | CUUAUAGUAUCAGUAACAG | [2196-2214] | — | — | — | — |
| 275 | Hum | UCCUGUUACUGAUACUAUA | UAUAGUAUCAGUAACAGGA | [2194-2212] | — | — | — | — |
| 276 | Hum | AUCCUGUUACUGAUACUAU | AUAGUAUCAGUAACAGGAU | [2193-2211] | — | — | — | — |
| 277 | Hum | CAGGUGUGAUCCUGUUACU | AGUAACAGGAUCACACCUG | [2185-2203] | — | — | — | — |
| 278 | Hum | UAGGGACAGAUGUAUUCAU | AUGAAUACAUCUGUCCCUA | [2148-2166] | — | — | — | — |
| 279 | Hum | GCUAUUAGCUCCACUUCAC | GUGAAGUGGAGCUAAUAGC | [2113-2131] | — | — | — | — |
| 280 | Hum | GCCCUAGCUAUUAGCUCCA | UGGAGCUAAUAGCUAGGGC | [2107-2125] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 281 | Hum | UCGUGGAUAAGGAGCUUAU | AUAAGCUCCUUAUCCACGA | [2077-2095] | — | — | — | — |
| 282 | Hum | AAGGCUUUCAUAUCCUUGC | GCAAGGAUAUGAAAGCCUU | [2052-2070] | — | — | — | — |
| 283 | Hum | CCACUCAACAAUGUUCAAU | AUUGAACAUUGUUGAGUGG | [2028-2046] | — | — | — | — |
| 284 | Hum | CCUCCACUCAACAAUGUUC | GAACAUUGUUGAGUGGAGG | [2025-2043] | — | — | — | — |
| 285 | Hum | GGAUACCUGUCACUAGGGA | UCCCUAGUGACAGGUAUCC | [1923-1941] | — | — | — | — |
| 286 | Hum | ACCUUGGAUACCUGUCACU | AGUGACAGGUAUCCAAGGU | [1918-1936] | — | — | — | — |
| 287 | Hum | UCACCGUCCAGAUAACCAU | AUGGUUAUCUGGACGGUGA | [1878-1896] | — | — | — | — |
| 288 | Hum | AACUCACCGUCCAGAUAAC | GUUAUCUGGACGGUGAGUU | [1875-1893] | — | — | — | — |
| 289 | Hum | GAGAUAUGGUUUAUAGUAC | GUACUAUAAACCAUAUCUC | [1842-1860] | — | — | — | — |
| 290 | Hum | GCAUUGGCUAUGGAGAUAU | AUAUCUCCAUAGCCAAUGC | [1830-1848] | — | — | — | — |
| 291 | Hum, chimp | AACGAGGUAAUAUUUGAGG | CCUCAAAUAUUACCUCGUU | [336-354] | — | — | [456-474] | — |
| 292 | Hum, chimp | CAACGAGGUAAUAUUUGAG | CUCAAAUAUUACCUCGUUG | [335-353] | — | — | [455-473] | — |
| 293 | Hum | CUGUAUACUACCACUUUGA | UCAAAGUGGUAGUAUACAG | [1781-1799] | — | — | — | — |
| 294 | Hum | UAGCUGUAUACUACCACUU | AAGUGGUAGUAUACAGCUA | [1778-1796] | — | — | — | — |
| 295 | Hum | GUAGCUGUAUACUACCACU | AGUGGUAGUAUACAGCUAC | [1777-1795] | — | — | — | — |
| 296 | Hum | UGGCAGUGUUAUCUCAUCU | AGAUGAGAUAACACUGCCA | [1704-1722] | — | — | — | — |
| 297 | Hum | UCUCAGAUGAACCAUUUCA | UGAAAUGGUUCAUCUGAGA | [1682-1700] | — | — | — | — |
| 298 | Hum | UAAUCUCAGAUGAACCAUU | AAUGGUUCAUCUGAGAUUA | [1679-1697] | — | — | — | — |
| 299 | Hum | CCCUCUCUGAUUCACUUAG | CUAAGUGAAUCAGAGAGGG | [1628-1646] | — | — | — | — |
| 300 | Hum | AGUCCCUCUCUGAUUCACU | AGUGAAUCAGAGAGGGACU | [1625-1643] | [1278-1288] (11/11) | — | — | — |
| 301 | Hum | UAGUCCCUCUCUGAUUCAC | GUGAAUCAGAGAGGGACUA | [1624-1642] | [1278-1288] (11/11) | — | — | — |
| 302 | Hum | UUGAUUACUCUUCCAUUGA | UCAAUGGAAGAGUAAUCAA | [1560-1578] | — | — | — | — |
| 303 | Hum | GUGUAGUUGAUUACUCUUC | GAAGAGUAAUCAACUACAC | [1554-1572] | — | — | — | — |
| 304 | Hum | CCCCUGUUCUUAAGUGUUG | CAACACUUAAGAACAGGGG | [1484-1502] | — | — | — | — |
| 305 | Hum | UUCCCUGUUCUUAAGUGU | ACACUUAAGAACAGGGAA | [1482-1500] | — | — | — | — |
| 306 | Hum | CAGUUUCCCUGUUCUUAA | UUAAGAACAGGGAAACUG | [1478-1496] | — | — | — | — |
| 307 | Hum | GCCUUUAUAAGCUCAGUUU | AAACUGAGCUUAUAAAGGC | [1465-1483] | — | — | — | — |
| 308 | Hum | GUGUUGUUUUAGAUGCCUU | AAGGCAUCUAAAACAACAC | [1451-1469] | — | — | — | — |
| 309 | Hum | ACGGUGUUGUUUUAGAUGC | GCAUCUAAAACAACACCGU | [1448-1466] | — | — | — | — |
| 310 | Hum | CCACGGUGUUGUUUUAGAU | AUCUAAAACAACACCGUGG | [1446-1464] | — | — | — | — |
| 311 | Hum | UCAGUAACCACGGUGUUGU | ACAACACCGUGGUUACUGA | [1439-1457] | — | — | — | — |
| 312 | Hum | CCAUUUCAGUAACCACGGU | ACCGUGGUUACUGAAAUGG | [1434-1452] | — | — | — | — |
| 313 | Hum | GUAGGAUUAAGUAGGUGAG | CUCACCUACUUAAUCCUAC | [1289-1307] | — | — | — | — |
| 314 | Hum | GGUAGGAUUAAGUAGGUGA | UCACCUACUUAAUCCUACC | [1288-1306] | — | — | — | — |

TABLE A-continued

| | | | | Hum 34222182 cds = | | | | |
|---|---|---|---|---|---|---|---|---|
| No | Sp-Source | Sense siRNA | AntiSense siRNA | 204-785 | Mouse 31541838 | rat 62644440 | chimp 55622975 | dog 74002279 |
| 315 | Hum | AAGGGUUUUUAGACAGGAA | UUCCUGUCUAAAAACCCUU | [1269-1287] | — | — | — | — |
| 316 | Hum | UUGAAGGGUUUUUAGACAG | CUGUCUAAAAACCCUUCAA | [1266-1284] | — | — | — | — |
| 317 | Hum | CAGUUCCUGACUCAAAUUU | AAAUUUGAGUCAGGAACUG | [1249-1267] | — | — | — | — |
| 318 | Hum | ACCAGUUCCUGACUCAAAU | AUUUGAGUCAGGAACUGGU | [1247-1265] | — | — | — | — |
| 319 | Hum | CCUAUCAAACUUCCAAAA | UUUUGGAAGUUUGAUAGG | [1219-1237] | — | — | — | [1182-1194] (13/13) |
| 320 | Hum, chimp | UGCUAAGUGAUUUUGACUA | UAGUCAAAAUCACUUAGCA | [286-304] | [284-302] (18/19) | [165-183] (18/19) | [406-424] | [268-286] (18/19) |
| 321 | Hum | UCCACAAUUUGGUUUCAGG | CCUGAAACCAAAUUGUGGA | [1081-1099] | — | — | — | — |
| 322 | Hum | UGAUUCCACAAUUUGGUUU | AAACCAAAUUGUGGAAUCA | [1077-1095] | — | — | — | — |
| 323 | Hum | AUAGAUCCCAUUUUUGUAC | GUACAAAAAUGGGAUCUAU | [1000-1018] | — | — | — | — |
| 324 | Hum, chimp | CAGAGAGCCUGCUAAGUGA | UCACUUAGCAGGCUCUCUG | [277-295] | [283-293] (11/11) | [164-174] (11/11) | [397-415] | [263-273] (11/11) |
| 325 | Hum | GUAGAUUUUCUGCAUAGAU | AUCUAUGCAGAAAAUCUAC | [987-1005] | — | — | — | — |
| 326 | Hum | UAGUGUAGAUUUUCUGCAU | AUGCAGAAAAUCUACACUA | [983-1001] | — | — | — | — |
| 327 | Hum | AUAGUGUAGAUUUUCUGCA | UGCAGAAAAUCUACACUAU | [982-1000] | — | — | — | — |
| 328 | Hum | UGUUUCACAUUCAUAGCAA | UUGCUAUGAAUGUGAAACA | [916-934] | — | — | — | — |
| 329 | Hum | CACCUGCCCUAAAUAAGAA | UUCUUAUUUAGGGCAGGUG | [869-887] | — | — | — | — |
| 330 | Hum | AAAGUCAUUUGUAGUUUGC | GCAAACUACAAAUGACUUU | [848-866] | [845-861] (17/17) | — | — | [834-845] (12/12) |
| 331 | Hum | GCUAGUCAGCUAAAGUCAU | AUGACUUUAGCUGACUAGC | [837-855] | — | — | — | — |
| 332 | Hum | UCAGCUAGUCAGCUAAAGU | ACUUUAGCUGACUAGCUGA | [834-852] | — | — | — | — |
| 333 | Hum | GGGUAGUAAAACUAUUCAG | CUGAAUAGUUUUACUACCC | [819-837] | — | — | — | — |
| 334 | Hum, chimp | CCAGCAUUUCAGAAUUGCU | AGCAAUUCUGAAAUGCUGG | [241-259] | [239-251] (13/13) | [120-138] (18/19) | [361-379] | — |
| 335 | Hum, ms | CAGCUCAGGAUUUCGACUU | AAGUCGAAAUCCUGAGCUG | [713-731] | [711-729] | [592-610] (18/19) | — | — |
| 336 | Hum, rat | GAACUCUGAUCCUCAGCUC | GAGCUGAGGAUCAGAGUUC | [700-718] | — | [579-597] | — | — |
| 337 | Hum | CGCUUCUCCUCUGGUUUCA | UGAAACCAGAGGAGAAGCG | [678-696] | [676-686] (11/11) | — | — | — |
| 338 | Hum | GACUUUUUCUUUAGUAGAG | CUCUACUAAAGAAAAAGUC | [657-675] | — | — | [777-789] (13/13) | — |
| 339 | Hum | UCAGGGACUUUUUCUUUAG | CUAAAGAAAAAGUCCCUGA | [652-670] | — | — | [772-789] (18/18) | — |
| 340 | Hum, chimp | UUCAGGGACUUUUUCUUUA | UAAAGAAAAAGUCCCUGAA | [651-669] | — | — | [771-789] | — |
| 341 | Hum, chimp | CUUUUGAGCUUACACUUGU | ACAAGUGUAAGCUCAAAAG | [601-619] | — | — | [721-739] | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 342 | Hum | UACCUACUUUUGAGCUUAC | GUAAGCUCAAAAGUAGGUA | [595-613] | — | — | [717-733] (17/17) | — |
| 343 | Hum | GUACCUACUUUUGAGCUUA | UAAGCUCAAAAGUAGGUAC | [594-612] | — | — | [717-732] (16/16) | — |
| 344 | Hum, rat, chimp, dog | GUGAACUUGGAAAUUGAAA | UUUCAAUUUCCAAGUUCAC | [531-549] | [529-547] (18/19) | [410-428] | [651-669] | [513-531] |
| 345 | Hum, rat, dog | GCACGUGAACUUGGAAAUU | AAUUUCCAAGUUCACGUGC | [527-545] | [525-539] (15/15) | [406-424] | [651-665] (15/15) | [509-527] |
| 346 | Hum, ms, chimp, dog | UCCCUGAGAAACUGACCCA | UGGGUCAGUUUCUCAGGGA | [442-460] | [440-458] | [323-339] (17/17) | [562-580] | [424-442] |
| 347 | Hum, chimp | AGGUCCUUGUCCCUGAGAA | UUCUCAGGGACAAGGACCU | [433-451] | [439-449] (11/11) | — | [553-571] | [417-433] (17/17) |
| 348 | Hum, chimp | GCAAACUAAACUUGGUUGC | GCAACCAAGUUUAGUUUGC | [410-428] | [408-426] (18/19) | — | [530-548] | — |
| 349 | Hum, chimp | GUCCAAAUCAAAGCAAACU | AGUUUGCUUUGAUUUGGAC | [398-416] | [396-413] (17/18) | [277-294] (17/18) | [518-536] | [380-397] (18/18) |
| 350 | Hum, chimp, dog | UCUGUCCAAAUCAAAGCAA | UUGCUUUGAUUUGGACAGA | [395-413] | — | — | [515-533] | [377-395] |
| 351 | Hum | CCUGUUAUGCUUACAAAAU | AUUUUGUAAGCAUAACAGG | [2480-2496] | — | — | — | — |
| 352 | Hum | GCCUGUUAUGCUUACAAAA | UUUUGUAAGCAUAACAGGC | [2479-2497] | — | — | — | — |
| 353 | Hum | CAGUUAUCUUUGACUCUCU | AGAGAGUCAAAGAUAACUG | [2459-2477] | — | — | — | — |
| 354 | Hum | CACUAACAGUUAUCUUUGA | UCAAAGAUAACUGUUAGUG | [2453-2471] | — | — | — | — |
| 355 | Hum | UCCACUAACAGUUAUCUUU | AAAGAUAACUGUUAGUGGA | [2451-2469] | — | — | — | — |
| 356 | Hum, chimp, dog | AGAACUGUCUGUCCAAAUC | GAUUUGGACAGACAGUUCU | [388-406] | [386-400] (15/15) | [267-282] (16/16) | [508-526] | [370-388] |
| 357 | Hum | UGACUGGGCAAGGCUUCUU | AAGAAGCCUUGCCCAGUCA | [2403-2421] | — | — | — | — |
| 358 | Hum | UCACUGUGUUUCUGCCGCU | AGCGGCAGAAACACAGUGA | [2365-2383] | [2460-2470] (11/11) | — | — | — |
| 359 | Hum | AAGGUUCACUGUGUUUCUG | CAGAAACACAGUGAACCUU | [2360-2378] | [2460-2470] (11/11) | — | — | — |
| 360 | Hum | CCAAGAUAAAUCAAUGUUG | CAACAUUGAUUUAUCUUGG | [2315-2333] | — | — | — | — |
| 361 | Hum | GAUACUACAAAGCCAAUCU | AGAUUGGCUUUGUAGUAUC | [2283-2301] | [1571-1581] (11/11) | — | — | — |
| 362 | Hum | AAAGAUACUACAAAGCCAA | UUGGCUUUGUAGUAUCUUU | [2280-2298] | [1571-1581] (11/11) | — | — | — |
| 363 | Hum | GAAAGAUACUACAAAGCCA | UGGCUUUGUAGUAUCUUUC | [2279-2297] | [1571-1581] (11/11) | — | — | — |
| 364 | Hum | UGGAAAGAUACUACAAAGC | GCUUUGUAGUAUCUUUCCA | [2277-2295] | [1571-1581] (11/11) | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 365 | Hum | UUGGAAAGAUACUACAAAG | CUUUGUAGUAUCUUUCCAA | [2276-2294] | [1571-1581] (11/11) | — | — | — |
| 366 | Hum | UGCUUGGAAAGAUACUACA | UGUAGUAUCUUUCCAAGCA | [2273-2291] | — | — | — | — |
| 367 | Hum | AUGCUUGGAAAGAUACUAC | GUAGUAUCUUUCCAAGCAU | [2272-2290] | — | — | — | — |
| 368 | Hum | CUAAACUCUUCAAAUGCUU | AAGCAUUUGAAGAGUUUAG | [2259-2277] | — | — | — | — |
| 369 | Hum | AAGUGACCUAAAAUGUCAC | GUGACAUUUUAGGUCACUU | [2212-2230] | — | — | — | — |
| 370 | Hum | UGAUCCUGUUACUGAUACU | AGUAUCAGUAACAGGAUCA | [2191-2209] | — | — | — | — |
| 371 | Hum | ACAGGUGUGAUCCUGUUAC | GUAACAGGAUCACACCUGU | [2184-2202] | — | — | — | — |
| 372 | Hum | AUCCUGGUGUUACUGAAAA | UUUUCAGUAACACCAGGAU | [2165-2183] | — | — | — | — |
| 373 | Hum | GGACAGAUGUAUUCAUCCU | AGGAUGAAUACAUCUGUCC | [2151-2169] | — | — | — | — |
| 374 | Hum | AGCUCCACUUCACAUGCUG | CAGCAUGUGAAGUGGAGCU | [2119-2137] | — | — | — | — |
| 375 | Hum | AGCUAUUAGCUCCACUUCA | UGAAGUGGAGCUAAUAGCU | [2112-2130] | — | — | — | — |
| 376 | Hum, chimp | CUUGCCAGAAUUUGGUUAA | UUAACCAAAUUCUGGCAAG | [361-379] | [361-377] (17/17) | [242-258] (17/17) | [481-499] | — |
| 377 | Hum | AAGGAGCUUAUUCAGGUUU | AAACCUGAAUAAGCUCCUU | [2085-2103] | — | — | — | — |
| 378 | Hum | GCUUUCAUAUCCUUGCUGU | ACAGCAAGGAUAUGAAAGC | [2055-2073] | — | — | — | — |
| 379 | Hum | UGAGAGAAUUUAGCCUCCA | UGGAGGCUAAAUUCUCUCA | [2012-2030] | — | — | — | — |
| 380 | Hum | AUGAGAGAAUUUAGCCUCC | GGAGGCUAAAUUCUCUCAU | [2011-2029] | — | — | — | — |
| 381 | Hum, chimp | GGAAUCAACUUGCCAGAAU | AUUCUGGCAAGUUGAUUCC | [353-371] | — | — | [473-491] | [340-351] (12/12) |
| 382 | Hum | UAGGGAAUAAUAAAGGCCU | AGGCCUUUAUUAUUCCCUA | [1936-1954] | — | — | — | — |
| 383 | Hum | UCACUAGGGAAUAAUAAAG | CUUUAUUAUUCCCUAGUGA | [1932-1950] | — | — | — | — |
| 384 | Hum | ACCUGUCACUAGGGAAUAA | UUAUUCCCUAGUGACAGGU | [1927-1945] | — | — | — | — |
| 385 | Hum | AUACCUGUCACUAGGGAAU | AUUCCCUAGUGACAGGUAU | [1925-1943] | — | — | — | — |
| 386 | Hum | UUGGAUACCUGUCACUAGG | CCUAGUGACAGGUAUCCAA | [1921-1939] | — | — | — | — |
| 387 | Hum | CACCUUGGAUACCUGUCAC | GUGACAGGUAUCCAAGGUG | [1917-1935] | — | — | — | — |
| 388 | Hum | ACCGUCCAGAUAACCAUGC | GCAUGGUUAUCUGGACGGU | [1880-1896] | — | — | — | — |
| 389 | Hum | GAAGUCUGCAUUGGCUAUG | CAUAGCCAAUGCAGACUUC | [1823-1841] | — | — | — | — |
| 390 | Hum | GAAUUAUUGAAACGGGUCA | UGACCCGUUUCAAUAAUUC | [1796-1816] | — | — | — | — |
| 391 | Hum | UAGUAGCUGUAUACUACCA | UGGUAGUAUACAGCUACUA | [1775-1793] | — | — | — | — |
| 392 | Hum | GGGUAGUAGCUGUAUACUA | UAGUAUACAGCUACUACCC | [1772-1790] | — | — | — | — |
| 393 | Hum | GUCAAGGGUAGUAGCUGUA | UACAGCUACUACCCUUGAC | [1767-1785] | — | — | — | — |
| 394 | Hum | UGAAGUAUCUCUCCUUAAC | GUUAAGGAGAGAUACUUCA | [1741-1759] | — | — | — | — |
| 395 | Hum | UUGAAGUAUCUCUCCUUAA | UUAAGGAGAGAUACUUCAA | [1740-1758] | — | — | — | — |
| 396 | Hum | GGGAAUUGAAGUAUCUCUC | GAGAGAUACUUCAAUUCCC | [1735-1753] | — | — | — | — |
| 397 | Hum | UGGGAAUUGAAGUAUCUCU | AGAGAUACUUCAAUUCCCA | [1734-1752] | — | — | — | — |
| 398 | Hum | GGCUUUUCUGGGAAUUGAA | UUCAAUUCCCAGAAAAGCC | [1726-1744] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 399 | Hum, chimp | CCCAACCUCAACGAGGUAA | UUACCUCGUUGAGGUUGGG | [327-345] | [325-341] (17/17) | [206-222] (17/17) | [447-465] | [309-325] (16/17) |
| 400 | Hum | GCAGUGUUAUCUAUCUCU | AGAGAUGAGAUAACACUGC | [1706-1724] | — | — | — | — |
| 401 | Hum | CUCAGAUGAACCAUUUCAC | GUGAAAUGGUUCAUCUGAG | [1683-1701] | — | — | — | — |
| 402 | Hum, chimp | CUGAACCCAACCUCAACGA | UCGUUGAGGUUGGGUUCAG | [322-340] | [320-338] (18/19) | [206-219] (14/14) | [442-460] | [306-319] (14/14) |
| 403 | Hum | CUGAUUCACUUAGUAAUCU | AGAUUACUAAGUGAAUCAG | [1634-1652] | — | — | — | — |
| 404 | Hum | CUCUGAUUCACUUAGUAAU | AUUACUAAGUGAAUCAGAG | [1632-1650] | — | — | — | — |
| 405 | Hum | CCUCUGAUUCACUUAGU | ACUAAGUGAAUCAGAGAGG | [1629-1647] | — | — | — | — |
| 406 | Hum, chimp | AGGAAACAGAGCCGUUGAC | GUCAACGGCUCUGUUUCCU | [184-202] | [183-200] (18/18) | [64-81] (18/18) | [304-322] | [167-184] (18/18) |
| 407 | Hum | UACUCUUCCAUUGAGUGAA | UUCACUCAAUGGAAGAGUA | [1565-1583] | — | — | — | — |
| 408 | Hum | GUGUGUAGUUGAUUACUCU | AGAGUAAUCAACUACACAC | [1552-1570] | — | — | — | — |
| 409 | Hum | GAACUGAUAUUUUGUGUG | CACACAAAAUAUCAGUUC | [1538-1556] | — | — | — | — |
| 410 | Hum | AAGUGUUGAAUACUGUCUU | AAGACAGUAUUCAACACUU | [1495-1513] | — | — | — | — |
| 411 | Hum | UCCCCUGUUCUUAAGUGUU | AACACUUAAGAACAGGGGA | [1483-1501] | — | — | — | — |
| 412 | Hum | GCUCAGUUUCCCUGUUCU | AGAACAGGGGAAACUGAGC | [1475-1493] | — | — | — | — |
| 413 | Hum | AGCUCAGUUUCCCCUGUUC | GAACAGGGGAAACUGAGCU | [1474-1492] | — | — | — | — |
| 414 | Hum, chimp | GGAUUAUGUUGUUCCUGAA | UUCAGGAACAACAUAAUCC | [308-326] | [306-323] (17/18) | — | [428-446] | — |
| 415 | Hum | UAAGCUCAGUUUCCCCUGU | ACAGGGGAAACUGAGCUUA | [1472-1490] | — | — | — | — |
| 416 | Hum | UGCCUUUAUAAGCUCAGUU | AACUGAGCUUAUAAAGGCA | [1464-1482] | — | — | — | — |
| 417 | Hum | AGAUGCCUUUAUAAGCUCA | UGAGCUUAUAAAGGCAUCU | [1461-1479] | — | — | — | — |
| 418 | Hum | UUAGAUGCCUUUAUAAGCU | AGCUUAUAAAGGCAUCUAA | [1459-1477] | — | — | — | — |
| 419 | Hum | CGGUGUUGUUUUAGAUGCC | GGCAUCUAAAACAACACCG | [1449-1467] | — | — | — | — |
| 420 | Hum | UAACCACGGUGUUGUUUUA | UAAAACAACACCGUGGUUA | [1443-1461] | — | — | — | — |
| 421 | Hum, chimp | CUACUGGGAUUAUGUUGUU | AACAACAUAAUCCCAGUAG | [302-320] | [300-317] (18/18) | [181-195] (15/15) | [422-440] | [284-302] (18/19) |
| 422 | Hum, ms, chimp | ACUACUGGGAUUAUGUUGU | ACAACAUAAUCCCAGUAGU | [301-319] | [299-317] (16/16) | [180-195] | [421-439] | [283-301] (18/19) |
| 423 | Hum | AUGGAACUGCUUCACUGUU | AACAGUGAAGCAGUUCCAU | [1361-1379] | — | — | — | — |
| 424 | Hum | UUACGGCAAUAAUGGAACU | AGUUCCAUUAUUGCCGUAA | [1350-1368] | — | — | — | — |
| 425 | Hum | AGGUGAGUUUAAUUAAAGC | GCUUUAAUUAAACUCACCU | [1301-1319] | — | — | — | — |
| 426 | Hum | AGGAUUAAGUAGGUGAGUU | AACUCACCUACUUAAUCCU | [1291-1309] | — | — | — | — |
| 427 | Hum | ACAGGAAGGUAGGAUUAAG | CUUAAUCCUACCUUCCUGU | [1281-1299] | — | — | — | — |
| 428 | Hum | AGGGUUUUUAGACAGGAAG | CUUCCUGUCUAAAAACCCU | [1270-1288] | — | — | — | — |
| 429 | Hum | GAAGGGUUUUUAGACAGGA | UCCUGUCUAAAAACCCUUC | [1268-1286] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 430 | Hum | UGAAGGGUUUUUAGACAGG | CCUGUCUAAAAACCCUUCA | [1267-1285] | — | — | — | — |
| 431 | Hum | UUUGAAGGGUUUUUAGACA | UGUCUAAAAACCCUUCAAA | [1265-1283] | — | — | — | — |
| 432 | Hum, chimp | GUGAUUUUGACUACUGGGA | UCCCAGUAGUCAAAAUCAC | [292-310] | [290-308] (18/19) | [171-189] (18/19) | [412-430] | [275-292] (18/18) |
| 433 | Hum | UCCUGACUCAAAUUUGAAG | CUUCAAAUUUGAGUCAGGA | [1253-1271] | — | — | — | — |
| 434 | Hum | UCUCUAAGUUUCAGAGGA | UCCUCUGAAAACUUAGAGA | [1163-1181] | — | — | — | — |
| 435 | Hum | AGGUAGGCUUGGUAAUAGA | UCUAUUACCAAGCCUACCU | [1097-1115] | — | — | — | — |
| 436 | Hum | ACAAUUUGGUUUCAGGUAG | CUACCUGAAACCAAAUUGU | [1084-1102] | — | — | — | — |
| 437 | Hum | GUUUUACAUUUGAUUCCAC | GUGGAAUCAAAUGUAAAAC | [1067-1085] | — | — | — | — |
| 438 | Hum | AAGCCCAUUUGAGUUUUAC | GUAAAACUCAAAUGGGCUU | [1055-1073] | — | — | — | — |
| 439 | Hum | UAGAAGCCCAUUUGAGUUU | AAACUCAAAUGGGCUUCUA | [1052-1070] | — | — | — | — |
| 440 | Hum | AAGCAAAAGUAGAAGCCCA | UGGGCUUCUACUUUUGCUU | [1043-1061] | — | — | — | — |
| 441 | Hum | UAGGUAAGCAAAAGUAGAA | UUCUACUUUUGCUUACCUA | [1038-1056] | — | — | — | — |
| 442 | Hum | GAAUAGGUAAGCAAAAGUA | UACUUUUGCUUACCUAUUC | [1035-1053] | — | — | — | — |
| 443 | Hum | GGAUGGAAUAGGUAAGCAA | UUGCUUACCUAUUCCAUCC | [1030-1048] | — | — | — | — |
| 444 | Hum | GGGAUGGAAUAGGUAAGCA | UGCUUACCUAUUCCAUCCC | [1029-1047] | — | — | — | — |
| 445 | Hum | AGAAUUGAAUGGGAUGGAA | UUCCAUCCCAUUCAAUUCU | [1019-1037] | — | — | — | — |
| 446 | Hum | CUGCAUAGAUCCCAUUUUU | AAAAAUGGGAUCUAUGCAG | [996-1014] | — | — | — | — |
| 447 | Hum | UAGAUUUUCUGCAUAGAUC | GAUCUAUGCAGAAAAUCUA | [968-1006] | — | — | — | — |
| 448 | Hum | GGCCUUUGGAGAAGUGAUU | AAUCACUUCUCCAAAGGCC | [959-977] | — | — | — | — |
| 449 | Hum, chimp | ACUGUGGCUAUCACCCAGA | UCUGGGUGAUAGCCACAGU | [262-280] | [263-275] (13/13) | — | [382-400] | — |
| 450 | Hum | GGCUGAUUUUCUGGCCUUU | AAAGGCCAGAAAAUCAGCC | [947-965] | — | — | — | — |
| 451 | Hum | ACAGGCUGAUUUUCUGGCC | GGCCAGAAAAUCAGCCUGU | [944-962] | [939-949] (11/11) | — | — | — |
| 452 | Hum | AACAGGCUGAUUUUCUGGC | GCCAGAAAAUCAGCCUGUU | [943-961] | [939-949] (11/11) | — | — | — |
| 453 | Hum | CUGCAGCUAACAGGCUGAU | AUCAGCCUGUUAGCUGCAG | [935-953] | — | — | — | — |
| 454 | Hum | AGCAACUGCAGCUAACAGG | CCUGUUAGCUGCAGUUGCU | [930-948] | — | — | — | — |
| 455 | Hum | UAGCAACUGCAGCUAACAG | CUGUUAGCUGCAGUUGCUA | [929-947] | — | — | — | — |
| 456 | Hum | UCAUAGCAACUGCAGCUAA | UUAGCUGCAGUUGCUAUGA | [926-944] | — | — | — | — |
| 457 | Hum | UCACAUUCAUAGCAACUGC | GCAGUUGCUAUGAAUGUGA | [920-938] | — | — | — | — |
| 458 | Hum, chimp | CAGAAUUGCUGGACUGUGG | CCACAGUCCAGCAAUUCUG | [250-268] | — | — | [370-388] | — |
| 459 | Hum | GCCCUAAAUAAGAAACCGC | GGGGUUUCUUAUUUAGGGC | [874-892] | — | — | — | — |
| 460 | Hum | CCACCUGCCCUAAAUAAGA | UCUUAUUUAGGGCAGGUGG | [868-886] | — | — | — | — |
| 461 | Hum | GUCAUUUGUAGUUUGCCCC | GGGGCAAACUACAAAUGAC | [851-889] | [846-862] (17/17) | — | — | [834-845] (12/12) |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 462 | Hum | GUAAACUAUUCAGCUAGU | ACUAGCUGAAUAGUUUUAC | [824-642] | — | — | — | — |
| 463 | Hum | UUGGGUAGUAAACUAUUC | GAAUAGUUUUACUACCCAA | [817-835] | — | — | — | — |
| 464 | Hum | CCUCAGCUCAGGAUUUCGA | UGGAAAUCCUGAGCUGAGG | [710-728] | [709-726] (18/18) | — | — | — |
| 465 | Hum | GGAGAACUCUGAUCCUCAG | CUGAGGAUCAGAGUUCUCC | [697-715] | — | [579-594] (16/16) | — | — |
| 466 | Hum | UCGCUUCUCCUCUGGUUUC | GAAACCAGAGGAGAAGCGA | [677-695] | [675-686] (12/12) | — | — | — |
| 467 | Hum | GUCGCUUCUCCUCUGGUUU | AAACCAGAGGAGAAGCGAC | [676-694] | [674-688] (13/13) | — | — | — |
| 468 | Hum | GGACUUUUCUUUAGUAGA | UCUACUAAAGAAAAGUCC | [656-674] | — | — | [776-789] (14/14) | — |
| 469 | Hum, chimp | UGGACUAGCUUCAGGGACU | AGUCCCUGAAGCUAGUCCA | [642-660] | — | — | [762-780] | [624-640] (17/17) |
| 470 | Hum, chimp, dog | UGCUCAUGGACUAGCUUCA | UGAAGCUAGUCCAUGAGCA | [636-654] | — | — | [756-774] | [618-636] |
| 471 | Hum | ACCUACUUUUGAGCUUACA | UGUAAGCUCAAAAGUAGGU | [596-614] | — | — | [717-734] (18/18) | — |
| 472 | Hum | UCGUACCUACUUUUGAGCU | AGCUCAAAAGUAGGUACGA | [592-610] | — | — | [712-730] (18/19) | — |
| 473 | Hum | CGUCGUACCUACUUUUGAG | CUCAAAAGUAGGUACGACG | [590-608] | — | — | [711-728] (17/18) | — |
| 474 | Hum, rat, dog | CACGUGAACUUGGAAAUUG | CAAUUUCCAAGUUCACGUG | [528-546] | [526-544] (18/19) | [407-425] | [651-666] (16/16) | [510-528] |
| 475 | Hum, chimp | UGCGAGGUUGUGUUAUGCA | UGCAUAACACAACCUCGCA | [511-529] | [514-527] (14/14) | [398-408] (11/11) | [631-649] | [493-511] (18/19) |
| 476 | Hum, chimp, dog | UUGUCCCUGAGAAACUGAC | GUCAGUUUCUCAGGGACAA | [439-457] | [439-455] (17/17) | [323-336] (14/14) | [559-577] | [421-439] |
| 477 | Hum, chimp, dog | UCCUUGUCCCUGAGAAACU | AGUUUCUCAGGGACAAGGA | [436-454] | [439-452] (14/14) | [323-333] (11/11) | [556-574] | [418-436] |
| 478 | Hum, chimp | UGACCAUGGUUGCAACUGG | GCAGUUGCAACCAUGGUCA | [199-217] | [197-212] (16/16) | [78-93] (16/16) | [319-337] | — |
| 479 | Hum, chimp | AACUAAACUGGUUGCUCA | UGAGCAACCAAGUUUAGUU | [413-431] | [415-428] (14/14) | — | [533-551] | [402-413] (12/12) |
| 480 | Hum, chimp | AGCAAACUAAACUGGUUG | CAACCAAGUUUAGUUUGCU | [409-427] | [407-425] (18/19) | — | [529-547] | — |
| 481 | Hum | UGUUAUGCUUACAAAAUGG | CCAUUUUGUAAGCAUAACA | [2482-2500] | — | — | — | — |
| 482 | Hum, chimp, dog | ACUGUCUGUCCAAAUCAAA | UUUGAUUUGGACAGACAGU | [391-409] | [389-407] (18/19) | [270-288] (18/19) | [511-529] | [373-391] |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 483 | Hum | CUAACAGUUAUCUUGACU | AGUCAAAGAUAACUGUUAG | [2455-2473] | — | — | — | — |
| 484 | Hum | GGGCAUCGAUGUAGAACUG | CAGUUCUACAUCGAUGCCC | [2422-2440] | — | — | — | — |
| 485 | Hum | UCCUGGAGUUGUCACCACU | AGUGGUGACAACUCCAGGA | [2385-2403] | — | — | — | — |
| 486 | Hum | UUGUUAAGCUCCAAAGGUU | AACCUUUGGAGCUUAACAA | [2347-2365] | — | — | — | — |
| 487 | Hum | UUGCAUGUCUAUUGUUAAG | CUUAACAAUAGACAUGCAA | [2336-2354] | — | — | — | — |
| 488 | Hum | AUGUUGUUUUGCAUGUCUA | UAGACAUGCAAAACAACAU | [2328-2348] | — | — | — | — |
| 489 | Hum | AAGAUACUACAAAGCCAAU | AUUGGCUUUGUAGUAUCUU | [2281-2299] | [1571-1581] (11/11) | — | — | — |
| 490 | Hum | CUUGGAAAGAUACUACAAA | UUUGUAGUAUCUUUCCAAG | [2275-2293] | — | — | — | — |
| 491 | Hum | UGUCACUGUUCAAAUUAGC | GCUAAUUUGAACAGUGACA | [2225-2243] | — | — | — | — |
| 492 | Hum | UGAUACUAUAAGUGACCUA | UAGGUCACUUAUAGUAUCA | [2203-2221] | — | — | — | — |
| 493 | Hum, ms, rat, chimp | CCGUUGACCAUGGUUGCAA | UUGCAACCAUGGUCAACGG | [195-213] | [193-211] | [74-92] | [315-333] | [177-195] (18/19) |
| 494 | Hum | GUGUUACUGAAAAACAGGU | ACCUGUUUUUCAGUAACAC | [2171-2189] | — | — | — | — |
| 495 | Hum | AGGGACAGAUGUAUUCAUC | GAUGAAUACAUCUGUCCCU | [2149-2167] | — | — | — | — |
| 496 | Hum | GGCGUAGGGACAGAUGUAU | AUACAUCUGUCCCUACGCC | [2144-2162] | — | — | — | — |
| 497 | Hum | CUCCACUUCACAUGCUGGA | UCCAGCAUGUGAAGUGGAG | [2121-2139] | — | — | — | — |
| 498 | Hum | UUCCUGCCCUAGCUAUUAG | CUAAUAGCUAGGGCAGGAA | [2102-2120] | — | — | — | — |
| 499 | Hum | AGGAGCUUAUUCAGGUUUC | GAAACCUGAAUAAGCUCCU | [2086-2104] | — | — | — | — |
| 500 | Hum | AUAAGGAGCUUAUUCAGGU | ACCUGAAUAAGCUCCUUAU | [2083-2101] | — | — | — | — |
| 501 | Hum, chimp | CAACUUGCCAGAAUUUGGU | ACCAAAUUCUGGCAAGUUG | [358-376] | [356-374] (18/19) | [237-255] (18/19) | [478-496] | [340-357] (17/18) |
| 502 | Hum | AAUUCAGCAAGGCUUUCAU | AUGAAAGCCUUGCUGAAUU | [2044-2062] | [2157-2167] (11/11) | — | — | — |
| 503 | Hum | UCAACAAUGUUCAAUUCAG | CUGAAUUGAACAUUGUUGA | [2032-2050] | — | — | — | — |
| 504 | Hum | UCCACUCAACAAUGUUCAA | UUGAACAUUGUUGAGUGGA | [2027-2045] | — | — | — | — |
| 505 | Hum | UUCCAACUAAGUAGAUCAU | AUGAUCUACUUAGUUGGAA | [1969-1987] | — | — | — | — |
| 506 | Hum | AGGGAAUAAUAAAGGCCUU | AAGGCCUUUAUUAUUCCCU | [1937-1955] | — | — | — | — |
| 507 | Hum | CACUAGGGAAUAAUAAAGG | CCUUUAUUAUUCCCUAGUG | [1933-1951] | — | — | — | — |
| 508 | Hum, chimp | GAGGAAUCAACUUGCCAGA | UCUGGCAAGUUGAUUCCUC | [351-369] | — | — | [471-489] | [340-351] (12/12) |
| 509 | Hum | CCUGUCACUAGGGAAUAAU | AUUAUUCCCUAGUGACAGG | [1928-1946] | — | — | — | — |
| 510 | Hum | CAUGCAUGCACCCAGAUUU | AAAUCUGGGUGCAUGCAUG | [1894-1912] | — | — | — | — |
| 511 | Hum | GUCCAGAUAACCAUGCAUG | CAUGCAUGGUUAUCUGGAC | [1883-1901] | — | — | — | — |
| 512 | Hum | CCGUCCAGAUAACCAUGCA | UGCAUGGUUAUCUGGACGG | [1881-1899] | — | — | — | — |
| 513 | Hum | GAAUGAAACUCACCGUCCA | UGGACGGUGAGUUUCAUUC | [1869-1887] | — | — | — | — |
| 514 | Hum | GAGAAUGAAACUCACCGUC | GACGGUGAGUUUCAUUCUC | [1867-1885] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 515 | Hum | ACAGCCUAGAGAAUGAAAC | GUUUCAUUCUCUAGGCUGU | [1859-1877] | — | — | — | — |
| 516 | Hum | CUGCAUUGGCUAUGGAGAU | AUCUCCAUAGCCAAUGCAG | [1828-1846] | — | — | — | — |
| 517 | Hum | AGUCUGCAUUGGCUAUGGA | UCCAUAGCCAAUGCAGACU | [1825-1843] | — | — | — | — |
| 518 | Hum | AAGUCUGCAUUGGCUAUGG | CCAUAGCCAAUGCAGACUU | [1824-1842] | — | — | — | — |
| 519 | Hum | UUGAAUUAUUGAAACGGGU | ACCCGUUUCAAUAAUUCAA | [1796-1814] | — | — | — | — |
| 520 | Hum | GCUGUAUACUACCACUUUG | CAAAGUGGUAGUAUACAGC | [1780-1798] | — | — | — | — |
| 521 | Hum | AAGGGUAGUAGCUGUAUAC | GUAUACAGCUACUACCCUU | [1770-1788] | — | — | — | — |
| 522 | Hum | GAAGUAUCUCUCCUUAACC | GGUUAAGGAGAGAUACUUC | [1742-1760] | — | — | — | — |
| 523 | Hum | UUCUGGGAAUUGAAGUAUC | GAUACUUCAAUUCCCAGAA | [1731-1749] | — | — | — | — |
| 524 | Hum, chimp | AACCCAACCUCAACGAGGU | ACCUCGUUGAGGUUGGGUU | [325-343] | [325-341] (17/17) | [206-222] (17/17) | [445-463] | [307-325] (18/19) |
| 525 | Hum | AUGAACCAUUUCACCAUGG | CCAUGGUGAAAUGGUUCAU | [1688-1706] | — | — | — | — |
| 526 | Hum | AGAUGAACCAUUUCACCAU | AUGGUGAAAUGGUUCAUCU | [1686-1704] | — | — | — | — |
| 527 | Hum | AAUCUCAGAUGAACCAUUU | AAAUGGUUCAUCUGAGAUU | [1680-1698] | — | — | — | — |
| 528 | Hum | UGUGCUUAAUCUCAGAUGA | UCAUCUGAGAUUAAGCACA | [1673-1691] | — | — | — | — |
| 529 | Hum | AUGUGCUUAAUCUCAGAUG | CAUCUGAGAUUAAGCACAU | [1672-1690] | — | — | — | — |
| 530 | Hum | ACAUGUGCUUAAUCUCAGA | UCUGAGAUUAAGCACAUGU | [1670-1688] | — | — | — | — |
| 531 | Hum | UACAUGUGCUUAAUCUCAG | CUGAGAUUAAGCACAUGUA | [1669-1687] | — | — | — | — |
| 532 | Hum | CCUCUUUUCAGUAUUACAU | AUGUAAUACUGAAAAGAGG | [1655-1673] | — | — | — | — |
| 533 | Hum | CUCUCUGAUUCACUUAGUA | UACUAAGUGAAUCAGAGAG | [1630-1648] | — | — | — | — |
| 534 | Hum, chimp | AUGUUGUUCCUGAACCCAA | UUGGGUUCAGGAACAACAU | [313-331] | — | — | [433-451] | — |
| 535 | Hum | CCCUGUUCUUAAGUGUUGA | UCAACACUUAAGAACAGGG | [1485-1503] | — | — | — | — |
| 536 | Hum | AUGCCUUUAUAAGCUCAGU | ACUGAGCUUAUAAAGGCAU | [1463-1481] | — | — | — | — |
| 537 | Hum, chimp | CUGGGAUUAUGUUGUUCCU | AGGAACAACAUAAUCCCAG | [305-323] | [303-317] (15/15) | [184-195] (12/12) | [425-443] | — |
| 538 | Hum | CUAAUGUUUUAAAGAGGCA | UGCCUCUUUAAAACAUUAG | [1399-1417] | — | — | — | — |
| 539 | Hum, chimp | UUGACUACUGGGAUUAUGU | ACAUAAUCCCAGUAGUCAA | [298-316] | [298-314] (17/17) | [179-195] (17/17) | [418-436] | [280-295] (16/16) |
| 540 | Hum | UGAGAAAUAUUACGGCAAU | AUUGCCGUAAUAUUUCUCA | [1341-1359] | — | — | — | — |
| 541 | Hum | AUGAGAAAUAUUACGGCAA | UUGCCGUAAUAUUUCUCAU | [1340-1358] | — | — | — | — |
| 542 | Hum | GGUAAGAGUAAAUGAGAAA | UUUCUCAUUUACUCUUACC | [1329-1347] | — | — | — | — |
| 543 | Hum | CUAGGUAAGAGUAAAUGAG | CUCAUUUACUCUUACCUAG | [1326-1344] | — | — | — | — |
| 544 | Hum | AACCCUAGGUAAGAGUAAA | UUUACUCUUACCUAGGGUU | [1322-1340] | — | — | — | — |
| 545 | Hum | GGUGAGUUUAAUUAAAGCU | AGCUUUAAUUAAACUCACC | [1302-1320] | — | — | — | — |
| 546 | Hum | UAGACAGGAAGGUAGGAUU | AAUCCUACCUUCCUGUCUA | [1278-1296] | — | — | — | — |
| 547 | Hum | UGACUCAAAUUUGAAGGGU | ACCCUUCAAAUUUGAGUCA | [1256-1274] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 548 | Hum | CUGACUCAAAUUUGAAGGG | CCCUUCAAAUUUGAGUCAG | [1255-1273] | — | — | — | — |
| 549 | Hum | CACCAGUUCCUGACUCAAA | UUUGAGUCAGGAACUGGUG | [1246-1264] | — | — | — | — |
| 550 | Hum | ACCACCAGUUCCUGACUCA | UGAGUCAGGAACUGGUGGU | [1244-1262] | — | — | — | — |
| 551 | Hum | AAAGCCCACACCACCAGUU | AACUGGUGGUGUGGGCUUU | [1235-1253] | — | — | — | — |
| 552 | Hum | UAGGCUUGGUAAUAGACUA | UAGUCUAUUACCAAGCCUA | [1100-1118] | — | — | — | — |
| 553 | Hum | CAAUUUGGUUUCAGGUAGG | CCUACCUGAAACCAAAUUG | [1085-1103] | — | — | — | — |
| 554 | Hum | AGCCCAUUUGAGUUUUACA | UGUAAAACUCAAAUGGGCU | [1056-1074] | — | — | — | — |
| 555 | Hum, chimp | GCCUGCUAAGUGAUUUUGA | UCAAAAUCACUUAGCAGGC | [283-301] | [283-296] (14/14) | [164-177] (14/14) | [403-421] | — |
| 556 | Hum | AGCAAAAGUAGAAGCCCAU | AUGGGCUUCUACUUUUGCU | [1044-1062] | — | — | — | — |
| 557 | Hum | GUAAGCAAAAGUAGAAGCC | GGCUUCUACUUUUGCUUAC | [1041-1059] | — | — | — | — |
| 558 | Hum, chimp | GAGAGCCUGCUAAGUGAUU | AAUCACUUAGCAGGCUCUC | [279-297] | [283-295] (13/13) | [164-176] (13/13) | [399-417] | [263-279] (16/17) |
| 559 | Hum | GCAUAGAUCCCAUUUUUGU | ACAAAAAUGGGAUCUAUGC | [996-1016] | — | — | — | — |
| 560 | Hum | AGUGUAGAUUUUCUGCAUA | UAUGCAGAAAAUCUACACU | [984-1002] | — | — | — | — |
| 561 | Hum | UGGAGAAGUGAUUCAAAAU | AUUUUGAAUCACUUCUCCA | [965-983] | — | — | — | — |
| 562 | Hum | ACUGCAGCUAACAGGCUGA | UCAGCCUGUUAGCUGCAGU | [934-952] | — | — | — | — |
| 563 | Hum | CUGUGUUUCACAUUCAUAG | CUAUGAAUGUGAAACACAG | [913-931] | — | — | — | — |
| 564 | Hum | UUCUGUGUUUCACAUUCAU | AUGAAUGUGAAACACAGAA | [911-929] | — | — | — | — |
| 565 | Hum | CCCAAAUGUAGUCUCUUUU | AAAAGAGACUACAUUUGGG | [890-908] | — | — | — | — |
| 566 | Hum | CCCCAAAUGUAGUCUCUUU | AAAGAGACUACAUUUGGGG | [889-907] | — | — | — | — |
| 567 | Hum | AACCCCAAAUGUAGUCUCU | AGAGACUACAUUUGGGGUU | [887-905] | — | — | — | — |
| 568 | Hum | CUGCCUAAAUAAGAAACC | GGUUUCUUAUUUAGGGCAG | [872-890] | — | — | — | — |
| 569 | Hum | ACCUGCCCUAAAUAAGAAA | UUUCUUAUUUAGGGCAGGU | [870-888] | — | — | — | — |
| 570 | Hum | CCCACCUGCCCUAAAUAAG | CUUAUUUAGGGCAGGUGGG | [867-885] | — | — | — | — |
| 571 | Hum | CUCACUGAUUGGAACAACA | UGUUGUUCCAAUCAGUGAG | [749-767] | [751-761] (11/11) | [632-642] (11/11) | — | [736-749] (14/14) |
| 572 | Hum | CUCAGGAUUUCGACUUGUU | AACAAGUCGAAAUCCUGAG | [716-734] | [714-731] (18/18) | [599-613] (15/15) | — | — |
| 573 | Hum, ms | GCUCAGGAUUUCGACUUGU | ACAAGUCGAAAUCCUGAGC | [715-733] | [713-731] (18/19) | [594-612] (18/19) | — | — |
| 574 | Hum, ms | AGCUCAGGAUUUCGACUUG | CAAGUCGAAAUCCUGAGCU | [714-732] | [712-730] (18/19) | [593-611] (18/19) | — | — |
| 575 | Hum | AGGAGAACUCUGAUCCUCA | UGAGGAUCAGAGUUCUCCU | [696-714] | — | [579-593] (15/15) | — | — |
| 576 | Hum, chimp | GGCAGUUUGAGCAGCAAGA | UCUUGCUGCUCAAACUGCC | [216-234] | [214-232] (18/19) | [95-113] (18/19) | [336-354] | [198-216] (18/19) |
| 577 | Hum, chimp | UGAGCUUACACUUGUGUUU | AAACACAAGUGUAAGCUCA | [605-623] | — | — | [725-743] | [588-605] (17/18) |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 578 | Hum, chimp | UUUGAGCUUACACUUGUGU | ACACAAGUGUAAGCUCAAA | [603-621] | — | — | [723-741] | — |
| 579 | Hum | GUGUGUGAUUCUAGCGUCG | CGACGCUAGAAUCACACAC | [576-594] | — | — | [696-714] (18/19) | [568-571] (14/14) |
| 580 | Hum | UUGUGUGUGAUUCUAGCGU | ACGCUAGAAUCACACACAA | [574-592] | — | [453-468] (15/16) | [694-709] (16/16) | [556-571] (16/16) |
| 581 | Hum, rat, chimp | UGGAUAGGAUUGUGUGUGA | UCACACACAAUCCUAUCCA | [565-583] | — | [444-462] | [685-703] | [547-565] (18/19) |
| 582 | Hum, rat, chimp | AAAAGCUGGAUAGGAUUGU | ACAAUCCUAUCCAGCUUUU | [559-577] | [557-572] (16/16) | [438-456] | [679-697] | [541-559] (18/19) |
| 583 | Hum, ms, chimp, dog | GUAUGUAAAAGCUGGAUA | UAUCCAGCUUUUUACAUAC | [552-570] | [550-568] | [434-449] (16/16) | [672-690] | [534-552] |
| 584 | Hum, ms, chimp | AUGUAUGUAAAAGCUGGA | UCCAGCUUUUUACAUACAU | [550-568] | [548-566] | [429-447] (18/19) | [670-688] | [534-550] (17/17) |
| 585 | Hum, ms, chimp | CUGACCCAGAGAAUUGCUC | GAGCAAUUCUCUGGGUCAG | [453-471] | [451-469] | [332-348] (17/17) | [573-591] | [435-453] (18/19) |
| 586 | Hum, chimp | AUGGUUGCAACUGGCAGUU | AACUGCCAGUUGCAACCAU | [204-222] | [202-220] (18/19) | [83-101] (18/19) | [324-342] | [186-204] (18/19) |
| 587 | Hum | UGGAAGGCUGUUAAAUUAA | UUAAUUUAACAGCCUUCCA | [2511-2529] | — | — | — | — |
| 588 | Hum | GCUUAUGGAAGGCUGUUAA | UUAACAGCCUUCCAUAAGC | [2506-2524] | — | — | — | — |
| 589 | Hum, chimp, dog | CUGUCUGUCCAAAUCAAAG | CUUUGAUUUGGACAGACAG | [392-410] | [390-408] (18/19) | [271-289] (18/19) | [512-530] | [374-392] |
| 590 | Hum | AUGUAGAACUGUUGUCCUU | AAGGACAACAGUUCUACAU | [2430-2448] | — | — | — | — |
| 591 | Hum | GCAUCGAUGUAGAACUGUU | AACAGUUCUACAUCGAUGC | [2424-2442] | — | — | — | — |
| 592 | Hum | AAUGUUGUUUGCAUGUCU | AGACAUGCAAAACAACAUU | [2327-2345] | — | — | — | — |
| 593 | Hum | UGGGCCAAGAUAAAUCAAU | AUUGAUUUAUCUUGGCCCA | [2311-2329] | — | — | — | — |
| 594 | Hum | GAAUUGGGCCAAGAUAAAU | AUUUAUCUUGGCCCAAUUC | [2307-2325] | — | — | — | — |
| 595 | Hum | AGAAUUGGGCCAAGAUAAA | UUUAUCUUGGCCCAAUUCU | [2306-2324] | — | — | — | — |
| 596 | Hum | CUCUUCAAAUGCUUGGAAA | UUUCCAAGCAUUUGAAGAG | [2264-2282] | — | — | — | — |
| 597 | Hum | ACUCUUCAAAUGCUUGGAA | UUCCAAGCAUUUGAAGAGU | [2263-2281] | — | — | — | — |
| 598 | Hum | GUCACUGUUCAAAUUAGCC | GGCUAAUUUGAACAGUGAC | [2226-2244] | — | — | — | — |
| 599 | Hum | GUGACCUAAAAUGUCACUG | CAGUGACAUUUUAGGUCAC | [2214-2232] | — | — | — | — |
| 600 | Hum | CUGAUACUAUAAGUGACCU | AGGUCACUUAUAGUAUCAG | [2202-2220] | — | — | — | — |
| 601 | Hum | ACUGAUACUAUAAGUGACC | GGUCACUUAUAGUAUCAGU | [2201-2219] | — | — | — | — |
| 602 | Hum | UACUGAUACUAUAAGUGAC | GUCACUUAUAGUAUCAGUA | [2200-2218] | — | — | — | — |
| 603 | Hum | GAUCCUGUUACUGAUACUA | UAGUAUCAGUAACAGGAUC | [2192-2210] | — | — | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 604 | Hum | GGUGUGAUCCUGUUACUGA | UCAGUAACAGGAUCACACC | [2187-2205] | — | — | — | — |
| 605 | Hum | CUGAAAAACAGGUGUGAUC | GAUCACACCUGUUUUUCAG | [2177-2195] | — | — | — | — |
| 606 | Hum | UGGUGUUACUGAAAAACAG | CUGUUUUUCAGUAACACCA | [2169-2187] | — | — | — | — |
| 607 | Hum | CUGGUGUUACUGAAAAACA | UGUUUUUCAGUAACACCAG | [2168-2186] | — | — | — | — |
| 608 | Hum | UCCUGGUGUUACUGAAAAA | UUUUUCAGUAACACCAGGA | [2166-2184] | — | — | — | — |
| 609 | Hum | ACAGAUGUAUUCAUCCUGG | CCAGGAUGAAUACAUCUGU | [2153-2171] | — | — | — | — |
| 610 | Hum | GACAGAUGUAUUCAUCCUG | CAGGAUGAAUACAUCUGUC | [2152-2170] | — | — | — | — |
| 611 | Hum | GCUAGGGACAGAUGUAUU | AAUACAUCUGUCCCUACGC | [2145-2163] | — | — | — | — |
| 612 | Hum | UCCUGCCCUAGCUAUUAGC | GCUAAUAGCUAGGGCAGGA | [2103-2121] | — | — | — | — |
| 613 | Hum | GUGGAUAAGGAGCUUAUUC | GAAUAAGCUCCUUAUCCAC | [2079-2097] | — | — | — | — |
| 614 | Hum | UGCUGUGGGUCGUGGAUAA | UUAUCCACGACCCACAGCA | [2068-2086] | — | — | — | — |
| 615 | Hum, chimp | GAAUCAACUUGCCAGAAUU | AAUUCUGGCAAGUUGAUUC | [354-372] | — | — | [474-492] | [340-351] (12/12) |
| 616 | Hum | CCAACUAAGUAGAUCAUUA | UAAUGAUCUACUUAGUUGG | [1971-1989] | — | — | — | — |
| 617 | Hum | AAAGGCCUUAUUUUUUGUC | GACAAAAAUAAGGCCUUU | [1947-1965] | — | — | — | — |
| 618 | Hum | GGAAUAAUAAAGGCCUUAU | AUAAGGCCUUUAUUAUUCC | [1939-1957] | — | — | — | — |
| 619 | Hum | GGGAAUAAUAAAGGCCUUA | UAAGGCCUUUAUUAUUCCC | [1938-1956] | — | — | — | — |
| 620 | Hum | AACCAUGCAUGCACCCAGA | UCUGGGUGCAUGCAUGGUU | [1891-1909] | — | — | — | — |
| 621 | Hum | CAGAUAACCAUGCAUGCAC | GUGCAUGCAUGGUUAUCUG | [1886-1904] | — | — | — | — |
| 622 | Hum | CUCACCGUCCAGAUAACCA | UGGUUAUCUGGACGGUGAG | [1877-1895] | — | — | — | — |
| 623 | Hum | AUGAAACUCACCGUCCAGA | UCUGGACGGUGAGUUUCAU | [1871-1889] | — | — | — | — |
| 624 | Hum | AGAGAAUGAAACUCACCGU | ACGGUGAGUUUCAUUCUCU | [1866-1884] | — | — | — | — |
| 625 | Hum | GUACAGCCUAGAGAAUGAA | UUCAUUCUCUAGGCUGUAC | [1857-1875] | — | — | — | — |
| 626 | Hum | AUGGUUUAUAGUACAGCCU | AGGCUGUACUAUAAACCAU | [1847-1865] | — | — | — | — |
| 627 | Hum | AUGGAGAUAUGGUUUAUAG | CUAUAAACCAUAUCUCCAU | [1839-1857] | — | — | — | — |
| 628 | Hum | UGGCUAUGGAGAUAUGGUU | AACCAUAUCUCCAUAGCCA | [1834-1852] | — | — | — | — |
| 629 | Hum | UGCAUUGGCUAUGGAGAUA | UAUCUCCAUAGCCAAUGCA | [1829-1847] | — | — | — | — |
| 630 | Hum | GUAUACUACCACUUUGAAU | AUUCAAAGUGGUAGUAUAC | [1783-1801] | — | — | — | — |
| 631 | Hum | AGCUGUAUACUACCACUUU | AAAGUGGUAGUAUACAGCU | [1779-1797] | — | — | — | — |
| 632 | Hum | GGUAGUAGCUGUAUACUAC | GUAGUAUACAGCUACUACC | [1773-1791] | — | — | — | — |
| 633 | Hum | CAAGGGUAGUAGCUGUAUA | UAUACAGCUACUACCCUUG | [1769-1787] | — | — | — | — |
| 634 | Hum | UCCUUAACCCAAUUGUCA | UGACAAUUGGGGUUAAGGA | [1752-1770] | — | — | — | — |
| 635 | Hum | AAGUAUCUCUCCUUAACCC | GGGUUAAGGAGAGAUACUU | [1743-1761] | — | — | — | — |
| 636 | Hum | UCUGGGAAUUGAAGUAUCU | AGAUACUUCAAUUCCCAGA | [1732-1750] | — | — | — | — |
| 637 | Hum | UUUCUGGGAAUUGAAGUAU | AUACUUCAAUUCCCAGAAA | [1730-1748] | — | — | — | — |
| 638 | Hum | GGCAGUGUUAUCUCAUCUC | GAGAUGAGAUAACACUGCC | [1705-1723] | — | — | — | — |

TABLE A-continued

| | | | | Hum 34222182 cds = | | | | |
|---|---|---|---|---|---|---|---|---|
| No | Sp-Source | Sense siRNA | AntiSense siRNA | 204-785 | Mouse 31541838 | rat 62644440 | chimp 55622975 | dog 74002279 |
| 639 | Hum | AUGGCAGUGUUAUCUCAUC | GAUGAGAUAACACUGCCAU | [1703-1721] | — | — | — | — |
| 640 | Hum | CACCAUGGCAGUGUUAUCU | AGAUAACACUGCCAUGGUG | [1699-1717] | — | — | — | — |
| 641 | Hum | UGCUUAAUCUCAGAUGAAC | GUUCAUCUGAGAUUAAGCA | [1675-1693] | — | — | — | — |
| 642 | Hum | CAUGUGCUUAAUCUCAGAU | AUCUGAGAUUAAGCACAUG | [1671-1689] | — | — | — | — |
| 643 | Hum | UUACAUGUGCUUAAUCUCA | UGAGAUUAAGCACAUGUAA | [1668-1686] | — | — | — | — |
| 644 | Hum | CAGUAUUACAUGUGCUUAA | UUAAGCACAUGUAAUACUG | [1663-1681] | — | — | — | — |
| 645 | Hum | UCACUUAGUAAUCUAUCCU | AGGAUAGAUUACUAAGUGA | [1639-1657] | — | — | — | — |
| 646 | Hum | CUGUGAGGAUAGGAAAUUA | UAAUUUCCUAUCCUCACAG | [1594-1612] | — | — | — | — |
| 647 | Hum | AGUGUUGAAUACUGUCUUU | AAAGACAGUAUUCAACACU | [1496-1514] | — | — | — | — |
| 648 | Hum | UAAGUGUUGAAUACUGUCU | AGACAGUAUUCAACACUUA | [1494-1512] | — | — | — | — |
| 649 | Hum | CUGUUCUUAAGUGUUGAAU | AUUCAACACUUAAGAACAG | [1487-1505] | — | — | — | — |
| 650 | Hum | CCUGUUCUUAAGUGUUGAA | UUCAACACUUAAGAACAGG | [1486-1504] | — | — | — | — |
| 651 | Hum | GAUGCCUUUAUAAGCUCAG | CUGAGCUUAUAAAGGCAUC | [1462-1480] | — | — | — | — |
| 652 | Hum | UAGAUGCCUUUAUAAGCUC | GAGCUUAUAAAGGCAUCUA | [1460-1478] | — | — | — | — |
| 653 | Hum | GGUGUUGUUUUAGAUGCCU | AGGCAUCUAAAACAACACC | [1450-1468] | — | — | — | — |
| 654 | Hum | UAAAGAGGCAACAAAAGCU | AGCUUUUGUUGCCUCUUUA | [1408-1426] | — | — | — | — |
| 655 | Hum | GUUUUAAAGAGGCAACAAA | UUUGUUGCCUCUUUAAAAC | [1404-1422] | — | — | — | — |
| 656 | Hum | AUGUUUUAAAGAGGCAACA | UGUUGCCUCUUUAAAACAU | [1402-1420] | — | — | — | — |
| 657 | Hum | GCUUCACUGUUUCUUGGUG | CACCAAGAAACAGUGAAGC | [1369-1387] | — | — | — | [1333-1346] (14/14) |
| 658 | Hum | GAGAAAUAUUACGGCAAUA | UAUUGCCGUAAUAUUUCUC | [1342-1360] | — | — | — | — |
| 659 | Hum | ACUCAAAUUUGAAGGGUUU | AAACCCUUCAAAUUUGAGU | [1258-1276] | — | — | — | — |
| 660 | Hum, chimp | AAGUGAUUUUGACUACUGG | CCAGUAGUCAAAAUCACUU | [290-308] | — | — | [410-428] | [275-290] (16/16) |
| 661 | Hum, chimp | UAAGUGAUUUUGACUACUG | CAGUAGUCAAAAUCACUUA | [289-307] | — | — | [409-427] | [275-289] (15/15) |
| 662 | Hum | CACAGAAUCAUACUAAAUG | CAUUUAGUAUGAUUCUGUG | [1192-1210] | — | — | — | — |
| 663 | Hum, chimp | GCUAAGUGAUUUUGACUAC | GUAGUCAAAAUCACUUAGC | [287-305] | [285-303] (18/19) | [166-184] (18/19) | [407-425] | [269-287] (18/19) |
| 664 | Hum | CAGGUAGGCUUGGUAAUAG | CUAUUACCAAGCCUACCUG | [1096-1114] | — | — | — | — |
| 665 | Hum | UGGGAUGGAAUAGGUAAGC | GCUUACCUAUUCCAUCCCA | [1028-1046] | — | — | — | — |
| 666 | Hum | AUGGGAUGGAAUAGGUAAG | CUUACCUAUUCCAUCCCAU | [1027-1045] | — | — | — | — |
| 667 | Hum | UAGUCUCUUUUCUUUCUGU | ACAGAAAGAAAAGAGACUA | [898-916] | — | — | — | — |
| 668 | Hum | AAGAAACCCCAAAUGUAGU | ACUACAUUUGGGGUUUCUU | [883-901] | — | — | — | [866-878] (13/13) |
| 669 | Hum | CCCUAAAUAAGAAACCCCA | UGGGGUUUCUUAUUUAGGG | [875-893] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 670 | Hum | GAACAACAGUGAUUGAAGG | CCUUCAAUCACUGUUGUUC | [760-778] | — | — | — | — |
| 671 | Hum | CUGAUUGGAACAACAGUGA | UCACUGUUGUUCCAAUCAG | [753-771] | [751-767] (16/17) | [632-648] (16/17) | — | [736-751] (16/16) |
| 672 | Hum | GAUCCUCAGCUCAGGAUUU | AAAUCCUGAGCUGAGGAUC | [707-725] | [709-723] (15/15) | [586-604] (18/19) | — | — |
| 673 | Hum | UUCAGGAGAACUCUGAUCC | GGAUCAGAGUUCUCCUGAA | [693-711] | — | [579-590] (12/12) | — | — |
| 674 | Hum | UAGUAGAGGUCGCUUCUCC | GGAGAAGCGACCUCUACUA | [668-686] | [670-684] (15/15) | [552-564] (13/13) | — | [657-667] (11/11) |
| 675 | Hum, chimp | GCUUCAGGGACUUUUUCUU | AAGAAAAAGUCCCUGAAGC | [649-667] | — | — | [769-787] | — |
| 676 | Hum, chimp, dog | AAGCAGGAGAACUGCUCAU | AUGAGCAGUUCUCCUGCUU | [624-642] | — | — | [744-762] | [608-624] |
| 677 | Hum, chimp | GAGCUUACACUUGUGUUUA | UAAACACAAGUGUAAGCUC | [606-624] | — | — | [726-744] | [588-606] (18/19) |
| 678 | Hum | GUGUGAUUCUAGCGUCGUA | UACGACGCUAGAAUCACAC | [578-596] | — | — | [698-715] (17/18) | [560-571] (12/12) |
| 679 | Hum, chimp | AGGAUUGUGUGUGAUUCUA | UAGAAUCACACACAAUCCU | [570-588] | — | [449-463] (15/15) | [690-708] | [554-570] (17/17) |
| 680 | Hum, chimp | GGUCCUUGUCCCUGAGAAA | UUUCUCAGGGACAAGGACC | [434-452] | [439-450] (12/12) | — | [554-572] | [417-434] (18/18) |
| 681 | Hum | ACAAAAUGGUGAUGGCUUA | UAAGCCAUCACCAUUUUGU | [2492-2510] | — | — | — | — |
| 682 | Hum | CUCUCUUGCCUGUUAUGCU | AGCAUAACAGGCAAGAGAG | [2472-2490] | — | — | — | — |
| 683 | Hum | AUCUUUGACUCUCUUGCCU | AGGCAAGAGAGUCAAAGAU | [2464-2482] | — | — | — | — |
| 684 | Hum | UUCCACUAACAGUUAUCUU | AAGAUAACUGUUAGUGGAA | [2450-2468] | — | — | — | — |
| 685 | Hum | UCGAUGUAGAACUGUUGUC | GACAACAGUUCUACAUCGA | [2427-2445] | — | — | — | — |
| 686 | Hum | UCUUGGGCAUCGAUGUAGA | UCUACAUCGAUGCCCAAGA | [2418-2436] | — | — | — | — |
| 687 | Hum | AAGGCUUCUGGGCAUCGA | UCGAUGCCCAAGAAGCCUU | [2412-2430] | — | — | — | — |
| 688 | Hum | GUCUAUUGUUAAGCUCCAA | UUGGAGCUUAACAAUAGAC | [2342-2360] | — | — | — | — |
| 689 | Hum | UGUCUAUUGUUAAGCUCCA | UGGAGCUUAACAAUAGACA | [2341-2359] | — | — | — | — |
| 690 | Hum | UGCAUGUCUAUUGUUAAGC | GCUUAACAAUAGACAUGCA | [2337-2355] | — | — | — | — |
| 691 | Hum | UGUUUUGCAUGUCUAUUGU | ACAAUAGACAUGCAAAACA | [2332-2350] | — | — | — | — |
| 692 | Hum | UUGUUUUGCAUGUCUAUUG | CAAUAGACAUGCAAAACAA | [2331-2349] | — | — | — | — |
| 693 | Hum | AGUGACCUAAAAUGUCACU | AGUGACAUUUUAGGUCACU | [2213-2231] | — | — | — | — |
| 694 | Hum | GUUACUGAUACUAUAAGUG | CACUUAUAGUAUCAGUAAC | [2198-2216] | — | — | — | — |
| 695 | Hum | AAACAGGUGUGAUCCUGUU | AACAGGAUCACACCUGUUU | [2182-2200] | — | — | — | — |
| 696 | Hum | UCAUCCUGGUGUUACUGAA | UUCAGUAACACCAGGAUGA | [2163-2181] | — | — | — | — |
| 697 | Hum | GAUGUAUUCAUCCUGGUGU | ACACCAGGAUGAAUACAUC | [2156-2174] | — | — | — | — |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 698 | Hum | CUAGCUAUUAGCUCCACUU | AAGUGGAGCUAAUAGCUAG | [2110-2128] | — | — | — | — |
| 699 | Hum | UAAGGAGCUUAUUCAGGUU | AACCUGAAUAAGCUCCUUA | [2084-2102] | — | — | — | — |
| 700 | Hum | GUCGUGGAUAAGGAGCUUA | UAAGCUCCUUAUCCACGAC | [2076-2094] | — | — | — | — |
| 701 | Hum | UGUGGGUCGUGGAUAAGGA | UCCUUAUCCACGACCCACA | [2071-2089] | — | — | — | — |
| 702 | Hum | UUCAUAUCCUUGCUGUGGG | CCCACAGCAAGGAUAUGAA | [2058-2076] | — | — | — | — |
| 703 | Hum | UAAUGAGAGAAUUUAGCCU | AGGCUAAAUUCUCUCAUUA | [2009-2027] | — | — | — | — |
| 704 | Hum | GUUAAUGAGAGAAUUUAGC | GCUAAAUUCUCUCAUUAAC | [2007-2025] | — | — | — | — |
| 705 | Hum | CUUAUUCCAACUAAGUAGA | UCUACUUAGUUGGAAUAAG | [1965-1983] | — | — | — | — |
| 706 | Hum | UUGUCUUAUUCCAACUAAG | CUUAGUUGGAAUAAGACAA | [1961-1979] | — | — | — | — |
| 707 | Hum | GUCACUAGGGAAUAAUAAA | UUUAUUAUUCCCUAGUGAC | [1931-1949] | — | — | — | — |
| 708 | Hum | CUGUCACUAGGGAAUAAUA | UAUUAUUCCCUAGUGACAG | [1929-1947] | — | — | — | — |
| 709 | Hum | CGUCCAGAUAACCAUGCAU | AUGCAUGGUUAUCUGGACG | [1882-1900] | — | — | — | — |
| 710 | Hum | UAGAGAAUGAAACUCACCG | CGGUGAGUUUCAUUCUCUA | [1865-1883] | — | — | — | — |
| 711 | Hum | CUACCACUUUGAAUUAUUG | CAAUAAUUCAAAGUGGUAG | [1788-1806] | — | — | — | — |
| 712 | Hum | UGUCAAGGGUAGUAGCUGU | ACAGCUACUACCCUUGACA | [1766-1784] | — | — | — | — |
| 713 | Hum | CUCUCCUUAACCCCAAUUG | CAAUUGGGGUUAAGGAGAG | [1749-1767] | — | — | — | — |
| 714 | Hum | GAUGAACCAUUUCACCAUG | CAUGGUGAAAUGGUUCAUC | [1687-1705] | — | — | — | — |
| 715 | Hum | UUUCAGUAUUACAUGUGCU | AGCACAUGUAAUACUGAAA | [1660-1678] | — | — | — | — |
| 716 | Hum, chimp | UUCCUGAACCCAACCUCAA | UUGAGGUUGGGUUCAGGAA | [319-337] | [319-335] (16/17) | [206-216] (11-11) | [439-457] | [301-319] (18/19) |
| 717 | Hum | GUAAUCUAUCCUCUUUUCA | UGAAAAGAGGAUAGAUUAC | [1646-1664] | — | — | — | — |
| 718 | Hum, chimp | UUGUUCCUGAACCCAACCU | AGGUUGGGUUCAGGAACAA | [316-334] | — | — | [436-454] | [298-316] (18/19) |
| 719 | Hum | GGAAAUUAGUUCUGAGAUC | GAUCUCAGAACUAAUUUCC | [1605-1623] | — | — | — | — |
| 720 | Hum | AGGAUAGGAAAUUAGUUCU | AGAACUAAUUUCCUAUCCU | [1599-1617] | — | — | — | — |
| 721 | Hum | UGUGAGGAUAGGAAAUUAG | CUAAUUUCCUAUCCUCACA | [1595-1613] | — | — | — | — |
| 722 | Hum | CCUGUGAGGAUAGGAAAUU | AAUUUCCUAUCCUCACAGG | [1593-1611] | — | — | — | — |
| 723 | Hum | CUGAUAUUUUGUGUGUAG | CUACACACAAAAAUAUCAG | [1541-1559] | — | — | — | — |
| 724 | Hum | GUUCUUAAGUGUUGAAUAC | GUAUUCAACACUUAAGAAC | [1489-1507] | — | — | — | — |
| 725 | Hum, chimp | ACUGGGAUUAUGUUGUUCC | GGAACAACAUAAUCCCAGU | [304-322] | [302-317] (16/16) | [183-195] (13/13) | [424-442] | — |
| 726 | Hum | GGUGACUUCCUCACUCUAA | UUAGAGUGAGGAAGUCACC | [1384-1402] | — | — | — | — |
| 727 | Hum | UUGGUGACUUCCUCACUCU | AGAGUGAGGAAGUCACCAA | [1382-1400] | — | — | — | — |
| 728 | Hum | CACUGUUUCUUGGUGACUU | AAGUCACCAAGAAACAGUG | [1373-1391] | — | — | — | [1336-1346] (11/11) |
| 729 | Hum | CUUCACUGUUUCUUGGUGA | UCACCAAGAAACAGUGAAG | [1370-1388] | — | — | — | [1333-1346] (14/14) |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 730 | Hum | UAUUACGGCAAUAAUGGAA | UUCCAUUAUUGCCGUAAUA | [1348-1366] | — | — | — | — |
| 731 | Hum | UAGGUAAGAGUAAAUGAGA | UCUCAUUUACUCUUACCUA | [1327-1345] | — | — | — | — |
| 732 | Hum | CCCUAGGUAAGAGUAAAUG | CAUUUACUCUUACCUAGGG | [1324-1342] | — | — | — | — |
| 733 | Hum | UUAGACAGGAAGGUAGGAU | AUCCUACCUUCCUGUCUAA | [1277-1295] | — | — | — | — |
| 734 | Hum, chimp | CUAAGUGAUUUUGACUACU | AGUAGUCAAAAUCACUUAG | [288-306] | [286-304] (18/19) | [167-185] (18/19) | [408-426] | [270-288] (18/19) |
| 735 | Hum | AGAAGCCCAUUUGAGUUUU | AAAACUCAAAUGGGCUUCU | [1053-1071] | — | — | — | — |
| 736 | Hum | GUAGAAGCCCAUUUGAGUU | AACUCAAAUGGGCUUCUAC | [1051-1069] | — | — | — | — |
| 737 | Hum | AAGUAGAAGCCCAUUUGAG | CUCAAAUGGGCUUCUACUU | [1049-1067] | — | — | — | — |
| 738 | Hum | CAAAGUAGAAGCCCAUUUU | AAAUGGGCUUCUACUUUUG | [1046-1064] | — | — | — | — |
| 739 | Hum, chimp | AGCCUGCUAAGUGAUUUUG | CAAAAUCACUUAGCAGGCU | [282-300] | [283-296] (14/14) | [164-177] (14/14) | [402-420] | — |
| 740 | Hum | GGUAAGCAAAAGUAGAAGC | GCUUCUACUUUUGCUUACC | [1040-1058] | — | — | — | — |
| 741 | Hum | AGGUAAGCAAAAGUAGAAG | CUUCUACUUUUGCUUACCU | [1039-1057] | — | — | — | — |
| 742 | Hum | UGGAAUAGGUAAGCAAAAG | CUUUUGCUUACCUAUUCCA | [1033-1051] | — | — | — | — |
| 743 | Hum | AUGGAAUAGGUAAGCAAAA | UUUUGCUUACCUAUUCCAU | [1032-1050] | — | — | — | — |
| 744 | Hum | UUGAAUGGGAUGGAAUAGG | CCUAUUCCAUCCCAUUCAA | [1023-1041] | — | — | — | — |
| 745 | Hum, chimp | AGAGCCUGCUAAGUGAUUU | AAAUCACUUAGCAGGCUCU | [280-298] | [283-296] (14/14) | [164-177] (14/14) | [400-418] | [263-280] (17/18) |
| 746 | Hum | UCUGCAUAGAUCCCAUUUU | AAAAUGGGAUCUAUGCAGA | [995-1013] | — | — | — | — |
| 747 | Hum | UUCUGGCCUUUGGAGAAGU | ACUUCUCCAAAGGCCAGAA | [955-973] | — | — | — | — |
| 748 | Hum | UUUCUGUGUUUCACAUUCA | UGAAUGUGAAACACAGAAA | [910-928] | — | — | — | — |
| 749 | Hum | GUAGUCUCUUUUCUUUCUG | CAGAAAGAAAAGAGACUAC | [897-915] | — | — | — | — |
| 750 | Hum | GAAACCCCAAAUGUAGUCU | AGACUACAUUUGGGGUUUC | [885-903] | — | — | — | [867-878] (12/12) |
| 751 | Hum | GUAGUAAAACUAUUCAGCU | AGCUGAAUAGUUUUACUAC | [821-839] | — | — | — | — |
| 752 | Hum | GGUAGUAAAACUAUUCAGC | GCUGAAUAGUUUUACUACC | [820-838] | — | — | — | — |
| 753 | Hum | GAUUGGAACAACAGUGAUU | AAUCACUGUUGUUCCAAUC | [755-773] | — | — | — | [737-751] (15/15) |
| 754 | Hum | UACUCACUGAUUGGAACAA | UUGUUCCAAUCAGUGAGUA | [747-765] | [745-761] (16/17) | [626-642] (16/17) | — | [736-747] (12/12) |
| 755 | Hum, rat | GAUUUCGACUUGUUAAGAA | UUCUUAACAAGUCGAAAUC | [721-739] | [719-737] (18/19) | [600-618] | — | — |
| 756 | Hum | AGGAUUUCGACUUGUUAAG | CUUAACAAGUCGAAAUCCU | [719-737] | [717-731] (15/15) | [599-616] (18/18) | — | — |
| 757 | Hum | UCAGGAGAACUCUGAUCCU | AGGAUCAGAGUUCUCCUGA | [694-712] | — | [579-591] (13/13) | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 758 | Hum, chimp | GGACUAGCUUCAGGGACUU | AAGUCCCUGAAGCUAGUCC | [643-661] | — | — | [763-781] | [625-640] (16/16) |
| 759 | Hum, chimp, dog | CUCAUGGACUAGCUUCAGG | CCUGAAGCUAGUCCAUGAG | [638-656] | — | — | [758-776] | [620-638] |
| 760 | Hum, chimp, dog | GAGAACUGCUCAUGGACUA | UAGUCCAUGAGCAGUUCUC | [630-648] | — | — | [750-768] | [612-630] |
| 761 | Hum, chimp, dog | GGAGAACUGCUCAUGGACU | AGUCCAUGAGCAGUUCUCC | [629-647] | — | — | [749-767] | [611-629] |
| 762 | Hum, chimp, dog | CAGGAGAACUGCUCAUGGA | UCCAUGAGCAGUUCUCCUG | [627-645] | — | — | [747-765] | [609-627] |
| 763 | Hum, chimp | GCUUACACUUGUGUUUAAG | CUUAAACACAAGUGUAAGC | [608-626] | [613-624] (12/12) | — | [728-746] | [594-608] (15/15) |
| 764 | Hum, chimp | GGAUUGUGUGUGAUUCUAG | CUAGAAUCACACACAAUCC | [571-589] | — | [450-468] (18/19) | [691-709] | [554-571] (18/18) |
| 765 | Hum, rat, chimp | GGAUAGGAUUGUGUGUGAU | AUCACACACAAUCCUAUCC | [566-584] | — | [445-463] | [686-704] | [548-566] (18/19) |
| 766 | Hum, chimp | GGUUGCAACUGGCAGUUUG | CAAACUGCCAGUUGCAACC | [206-224] | — | — | [326-344] | [192-206] (15/15) |
| 767 | Hum, chimp | UAAACUUGGUUGCUCAAAG | CUUUGAGCAACCAAGUUUA | [416-434] | [415-428] (14/14) | — | [536-554] | [402-415] (14/14) |
| 768 | Hum | GGCUUAUGGAAGGCUGUUA | UAACAGCCUUCCAUAAGCC | [2505-2523] | — | — | — | — |
| 769 | Hum | AAAUGGUGAUGGCUUAUGG | CCAUAAGCCAUCACCAUUU | [2495-2513] | — | — | — | — |
| 770 | Hum | UCUCUUGCCUGUUAUGCUU | AAGCAUAACAGGCAAGAGA | [2473-2491] | — | — | — | — |
| 771 | Hum | UUCUGGGCAUCGAUGUAG | CUACAUCGAUGCCCAAGAA | [2417-2435] | — | — | — | — |
| 772 | Hum | AAGCUCCAAAGGUUCACUG | CAGUGAACCUUUGGAGCUU | [2352-2370] | — | — | — | — |
| 773 | Hum | UCUAUUGUUAAGCUCCAAA | UUUGGAGCUUAACAAUAGA | [2343-2361] | — | — | — | — |
| 774 | Hum | GGGCCAAGAUAAAUCAAUG | CAUUGAUUUAUCUUGGCCC | [2312-2330] | — | — | — | — |
| 775 | Hum | UAGAAUUGGGCCAAGAUAA | UUAUCUUGGCCCAAUUCUA | [2305-2323] | — | — | — | — |
| 776 | Hum | GGAAAGAUACUACAAAGCC | GGCUUUGUAGUAUCUUUCC | [2278-2296] | [1571-1581] (11/11) | — | — | — |
| 777 | Hum | UCAAAUGCUUGGAAAGAUA | UAUCUUUCCAAGCAUUUGA | [2268-2286] | — | — | — | — |
| 778 | Hum | GUUACUGAAAAACAGGUGU | ACACCUGUUUUUCAGUAAC | [2173-2191] | — | — | — | — |
| 779 | Hum | AUGUAUUCAUCCUGGUGUU | AACACCAGGAUGAAUACAU | [2157-2175] | — | — | — | — |
| 780 | Hum | CAGAUGUAUUCAUCCUGGU | ACCAGGAUGAAUACAUCUG | [2154-2172] | — | — | — | — |
| 781 | Hum | UGCCCUAGCUAUUAGCUCC | GGAGCUAAUAGCUAGGGCA | [2106-2124] | — | — | — | — |
| 782 | Hum | GAGCUUAUUCAGGUUUCCU | AGGAAACCUGAAUAAGCUC | [2088-2106] | — | — | — | — |
| 783 | Hum | GGAGCUUAUUCAGGUUUCC | GGAAACCUGAAUAAGCUCC | [2087-2105] | — | — | — | — |

TABLE A-continued

19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 784 | Hum | UCAUAUCCUUGCUGUGGGU | ACCCACAGCAAGGAUAUGA | [2059-2077] | — | — | — | — |
| 785 | Hum | GUUCAAUUCAGCAAGGCUU | AAGCCUUGCUGAAUUGAAC | [2040-2058] | [2152-2167] (15/16) | — | — | — |
| 786 | Hum | CAACAAUGUUCAAUUCAGC | GCUGAAUUGAACAUUGUUG | [2033-2051] | — | — | — | — |
| 787 | Hum | GUCUUAUUCCAACUAAGUA | UACUUAGUUGGAAUAAGAC | [1963-1981] | — | — | — | — |
| 788 | Hum | CUAGGGAAUAAUAAAGGCC | GGCCUUUAUUAUUCCCUAG | [1935-1953] | — | — | — | — |
| 789 | Hum | UAACCAUGCAUGCACCCAG | CUGGGUGCAUGCAUGGUUA | [1890-1908] | — | — | — | — |
| 790 | Hum | AGAUAACCAUGCAUGCACC | GGUGCAUGCAUGGUUAUCU | [1887-1905] | — | — | — | — |
| 791 | Hum | AGCCUAGAGAAUGAAACUC | GAGUUUCAUUCUCUAGGCU | [1861-1879] | — | — | — | — |
| 792 | Hum | UUAUAGUACAGCCUAGAGA | UCUCUAGGCUGUACUAUAA | [1852-1870] | — | — | — | — |
| 793 | Hum | GCUAUGGAGAUAUGGUUUA | UAAACCAUAUCUCCAUAGC | [1836-1854] | — | — | — | — |
| 794 | Hum | UCUCUCCUUAACCCCAAUU | AAUUGGGGUUAAGGAGAGA | [1748-1766] | — | — | — | — |
| 795 | Hum | AUCUCUCCUUAACCCCAAU | AUUGGGGUUAAGGAGAGAU | [1747-1765] | — | — | — | — |
| 796 | Hum | CUGGGCUUUUCUGGGAAUU | AAUUCCCAGAAAAGCCCAG | [1723-1741] | — | — | — | — |
| 797 | Hum | AACCAUUCACCAUGGCAG | CUGCCAUGGUGAAAUGGUU | [1691-1709] | — | — | — | — |
| 798 | Hum | UUCAGUAUUACAUGUGCUU | AAGCACAUGUAAUACUGAA | [1661-1679] | — | — | — | — |
| 799 | Hum | UCCUCUUUUCAGUAUUACA | UGUAAUACUGAAAAGAGGA | [1654-1672] | — | — | — | — |
| 800 | Hum | AUCCUCUUUUCAGUAUUAC | GUAAUACUGAAAAGAGGAU | [1653-1671] | — | — | — | — |
| 801 | Hum | CUAUCCUCUUUUCAGUAUU | AAUACUGAAAAGAGGAUAG | [1651-1669] | — | — | — | — |
| 802 | Hum | AAUCUAUCCUCUUUUCAGU | ACUGAAAAGAGGAUAGAUU | [1648-1666] | — | — | — | — |
| 803 | Hum | UUCACUUAGUAAUCUAUCC | GGAUAGAUUACUAAGUGAA | [1638-1656] | — | — | — | — |
| 804 | Hum | UAGGAAAUUAGUUCUGAGA | UCUCAGAACUAAUUUCCUA | [1603-1621] | — | — | — | — |
| 805 | Hum | GGAUAGGAAAUUAGUUCUG | CAGAACUAAUUUCCUAUCC | [1600-1618] | — | — | — | — |
| 806 | Hum | GAGGAUAGGAAAUUAGUUC | GAACUAAUUUCCUAUCCUC | [1598-1616] | — | — | — | — |
| 807 | Hum | GUGAGGAUAGGAAAUUAGU | ACUAAUUUCCUAUCCUCAC | [1596-1614] | — | — | — | — |
| 808 | Hum | GUAGGCUUGGUAAUAGACU | AGUCUAUUACCAAGCCUAC | [1099-1117] | — | — | — | — |
| 809 | Hum, chimp | CCUGCUAAGUGAUUUUGAC | GUCAAAAUCACUUAGCAGG | [284-302] | [283-296] (14/14) | [164-177] (14/14) | [404-422] | — |
| 810 | Hum | UGCAUAGAUCCCAUUUUUG | CAAAAAUGGGAUCUAUGCA | [997-1015] | — | — | — | — |
| 811 | Hum | UUCUUUCUGUGUUUCACAU | AUGUGAAACACAGAAAGAA | [907-925] | — | — | — | — |
| 812 | Hum | CAAAUGUAGUCUCUUUUCU | AGAAAAGAGACUACAUUUG | [892-910] | — | — | — | — |
| 813 | Hum | AAACCCCAAAUGUAGUCUC | GAGACUACAUUUGGGGUUU | [886-904] | — | — | — | [868-878] (11/11) |
| 814 | Hum | UGCCCUAAAUAAGAAACCC | GGGUUUCUUAUUUAGGGCA | [873-891] | — | — | — | — |
| 815 | Hum | AAACUAUUCAGCUAGUCAG | CUGACUAGCUGAAUAGUUU | [827-845] | — | — | — | — |
| 816 | Hum | GUGAUUGAAGGGUCCUAAA | UUUAGGACCCUUCAAUCAC | [768-786] | — | — | — | — |
| 817 | Hum | UCAGGAUUUCGACUUGUUA | UAACAAGUCGAAAUCCUGA | [717-735] | [715-731] (17/17) | [599-614] (16/16) | — | — |

TABLE A-continued 19 mer

| No | Sp-Source | Sense siRNA | AntiSense siRNA | Hum 34222182 cds = 204-785 | Mouse 31541838 | rat 62644440 | chimp 55622975 | dog 74002279 |
|---|---|---|---|---|---|---|---|---|
| 818 | Hum | UAGAGGUCGCUUCUCCUCU | AGAGGAGAAGCGACCUCUA | [671-689] | [670-686] (17/17) | [552-564] (13/13) | — | [657-667] (11/11) |
| 819 | Hum, chimp, dog | AACUGCUCAUGGACUAGCU | AGCUAGUCCAUGAGCAGUU | [633-651] | — | — | [753-771] | [615-633] |
| 820 | Hum | GGUGAUGGCUUAUGGAAGG | CCUUCCAUAAGCCAUCACC | [2499-2517] | — | — | — | — |
| 821 | Hum | AGGCUUCUUGGGCAUCGAU | AUCGAUGCCCAAGAAGCCU | [2413-2431] | — | — | — | — |
| 822 | Hum | UAAGCUCCAAAGGUUCACU | AGUGAACCUUUGGAGCUUA | [2351-2369] | — | — | — | — |
| 823 | Hum | GGCCAAGAUAAAUCAAUGU | ACAUUGAUUUAUCUUGGCC | [2313-2331] | — | — | — | — |
| 824 | Hum | UUCAAAUGCUUGGAAAGAU | AUCUUUCCAAGCAUUUGAA | [2267-2285] | — | — | — | — |
| 825 | Hum | GGGACAGAUGUAUUCAUCC | GGAUGAAUACAUCUGUCCC | [2150-2168] | — | — | — | — |
| 826 | Hum | AGCUUAUUCAGGUUUCCUG | CAGGAAACCUGAAUAAGCU | [2089-2107] | — | — | — | — |
| 827 | Hum | AUUCCAACUAAGUAGAUCA | UGAUCUACUUAGUUGGAAU | [1968-1986] | — | — | — | — |
| 828 | Hum | AGUACAGCCUAGAGAAUGA | UCAUUCUCUAGGCUGUACU | [1856-1874] | — | — | — | — |
| 829 | Hum | AUAGUACAGCCUAGAGAAU | AUUCUCUAGGCUGUACUAU | [1854-1872] | — | — | — | — |
| 830 | Hum | GGUUUAUAGUACAGCCUAG | CUAGGCUGUACUAUAAACC | [1849-1867] | — | — | — | — |
| 831 | Hum | GAUAUGGUUUAUAGUACAG | CUGUACUAUAAACCAUAUC | [1844-1862] | — | — | — | — |
| 832 | Hum | GGAGAUAUGGUUUAUAGUA | UACUAUAAACCAUAUCUCC | [1841-1859] | — | — | — | — |
| 833 | Hum | AACCCCAAUUGUCAAGGGU | ACCCUUGACAAUUGGGGUU | [1757-1775] | — | — | — | — |
| 834 | Hum | UAUCUCUCCUUAACCCCAA | UUGGGGUUAAGGAGAGAUA | [1746-1764] | — | — | — | — |
| 835 | Hum | GUAUCUCUCCUUAACCCCA | UGGGGUUAAGGAGAGAUAC | [1745-1763] | — | — | — | — |
| 836 | Hum | UCUGGGCUUUUCUGGGAAU | AUUCCCAGAAAAGCCCAGA | [1722-1740] | — | — | — | — |
| 837 | Hum | GAACCAUUUCACCAUGGCA | UGCCAUGGUGAAAUGGUUC | [1690-1708] | — | — | — | — |
| 838 | Hum | UCUAUCCUCUUUUCAGUAU | AUACUGAAAAGAGGAUAGA | [1650-1668] | — | — | — | — |
| 839 | Hum | UGUGUGUAGUUGAUUACUC | GAGUAAUCAACUACACACA | [1551-1569] | — | — | — | — |
| 840 | Hum | CUUAAGUGUUGAAUACUGU | ACAGUAUUCAACACUUAAG | [1492-1510] | — | — | — | — |
| 841 | Hum | UCUUAAGUGUUGAAUACUG | CAGUAUUCAACACUUAAGA | [1491-1509] | — | — | — | — |
| 842 | Hum | AAACCAGAUUUGCCUAUUU | AAAUAGGCAAAUCUGGUUU | [1122-1140] | — | — | — | — |
| 843 | Hum | CCUUUGGAGAAGUGAUUCA | UGAAUCACUUCUCCAAAGG | [961-979] | — | — | — | — |
| 844 | Hum | UGGCCUUUGGAGAAGUGAU | AUCACUUCUCCAAAGGCCA | [958-976] | — | — | — | — |
| 845 | Hum | UGUAGUCUCUUUUCUUUCU | AGAAAGAAAAGAGACUACA | [896-914] | — | — | — | — |
| 846 | Hum | CUAAAUAAGAAACCCCAAA | UUUGGGGUUUCUUAUUUAG | [877-895] | — | — | — | [866-877] (12/12) |
| 847 | Hum | CCUGCCCUAAAUAAGAAAC | GUUUCUUAUUUAGGGCAGG | [871-889] | — | — | — | — |
| 848 | Hum | AAACUUUACUCACUGAUUG | CAAUCAGUGAGUAAAGUUU | [741-759] | — | — | — | — |
| 849 | Hum | GAAAAACUUUACUCACUG | CAGUGAGUAAAGUUUUUC | [737-755] | — | — | — | — |
| 850 | Hum, rat | GGAUUUCGACUUGUUAAGA | UCUUAACAAGUCGAAAUCC | [720-738] | [718-736] (18/19) | [599-617] | — | — |

TABLE A-continued

| | | | | Hum 34222182 cds = | | | | |
|---|---|---|---|---|---|---|---|---|
| No | Sp-Source | Sense siRNA | AntiSense siRNA | 204-785 | Mouse 31541838 | rat 62644440 | chimp 55622975 | dog 74002279 |
| 851 | Hum | CAGGAUUUCGACUUGUUAA | UUAACAAGUCGAAAUCCUG | [718-736] | [716-731] (16/16) | [599-615] (17/17) | — | — |
| 852 | Hum, chimp | CUGGCAGUUUGAGCAGCAA | UUGCUGCUCAAACUGCCAG | [214-232] | [214-227] (14/14) | [95-108] (14/14) | [334-352] | [196-211] (16/16) |
| 853 | Hum, chimp | ACUGGCAGUUUGAGCAGCA | UGCUGCUCAAACUGCCAGU | [213-231] | [214-227] (14/14) | [95-108] (14/14) | [333-351] | [195-211] (17/17) |
| 854 | Hum, chimp | UAGGAUUGUGUGUGAUUCU | AGAAUCACACACAAUCCUA | [569-587] | — | [448-463] (16/16) | [689-707] | [554-569] (16/16) |
| 855 | Hum, rat, chimp | CUGGAUAGGAUUGUGUGUG | CACACACAAUCCUAUCCAG | [564-582] | [562-580] (18/19) | [443-461] | [684-702] | [546-564] (18/19) |
| 856 | Hum, chimp | CAAAGGUCCUUGUCCCUGA | UCAGGGACAAGGACCUUUG | [430-448] | — | — | [550-568] | [412-430] (18/19) |
| 857 | Hum, chimp | GUUGCUCAAAGGUCCUUGU | ACAAGGACCUUUGAGCAAC | [424-442] | [597-607] (11/11) | [478-488] (11/11) | [544-562] | — |
| 858 | Hum, chimp | AAACUUGGUUGCUCAAAGG | CCUUUGAGCAACCAAGUUU | [417-435] | [415-433] (18/19) | — | [537-555] | [402-415] (14/14) |
| 859 | Hum | UGGUGAUGGCUUAUGGAAG | CUUCCAUAAGCCAUCACCA | [2498-2516] | — | — | — | — |
| 860 | Hum | GGAGUUGUCACCACUGACU | AGUCAGUGGUGACAACUCC | [2389-2407] | — | — | — | — |
| 861 | Hum | ACAAUGUUCAAUUCAGCAA | UUGCUGAAUUGAACAUUGU | [2035-2053] | — | — | — | — |
| 862 | Hum, chimp | UGAGGAAUCAACUUGCCAG | CUGGCAAGUUGAUUCCUCA | [350-368] | — | — | [470-488] | [340-350] (11/11) |
| 863 | Hum | UGGAGAUAUGGUUUAUAGU | ACUAUAAACCAUAUCUCCA | [1840-1858] | — | — | — | — |
| 864 | Hum | CUAUGGAGAUAUGGUUUAU | AUAAACCAUAUCUCCAUAG | [1837-1855] | — | — | — | — |
| 865 | Hum | CCCCAAUUGUCAAGGGUAG | CUACCCUUGACAAUUGGGG | [1759-1777] | — | — | — | — |
| 866 | Hum | UAACCCCAAUUGUCAAGGG | CCCUUGACAAUUGGGGUUA | [1756-1774] | — | — | — | — |
| 867 | Hum | ACUUAGUAAUCUAUCCUCU | AGAGGAUAGAUUACUAAGU | [1641-1659] | — | — | — | — |
| 868 | Hum | CACUUAGUAAUCUAUCCUC | GAGGAUAGAUUACUAAGUG | [1640-1658] | — | — | — | — |
| 869 | Hum | AGGAAAUUAGUUCUGAGAU | AUCUCAGAACUAAUUUCCU | [1604-1622] | — | — | — | — |
| 870 | Hum | UGGUGACUUCCUCACUCUA | UAGAGUGAGGAAGUCACCA | [1383-1401] | — | — | — | — |
| 871 | Hum | GUUUCAGGUAGGCUUGGUA | UACCAAGCCUACCUGAAAC | [1092-1110] | — | — | — | — |
| 872 | Hum | AUAGGUAAGCAAAAGUAGA | UCUACUUUUGCUUACCUAU | [1037-1055] | — | — | — | — |
| 873 | Hum | ACAACAGUGAUUGAAGGGU | ACCCUUCAAUCACUGUUGU | [762-780] | — | — | — | — |
| 874 | Hum, chimp, dog | GAACUGCUCAUGGACUAGC | GCUAGUCCAUGAGCAGUUC | [632-650] | — | — | [752-770] | [614-632] |
| 875 | Hum, chimp, dog | GUGUUUAAGCAGGAGAACU | AGUUCUCCUGCUUAAACAC | [618-636] | [616-631] (16/16) | — | [738-756] | [600-618] |
| 876 | Hum, ms, | GAGAAACUGACCCAGAGAA | UUCUCUGGGUCAGUUUCUC | [447-465] | [445-463] | [326-344] | [567-585] | [429-445] |

TABLE A-continued

| | | | | Hum 34222182 cds = | | | | |
|---|---|---|---|---|---|---|---|---|
| No | Sp-Source | Sense siRNA | AntiSense siRNA | 204-785 | Mouse 31541838 | rat 62644440 | chimp 55622975 | dog 74002279 |
| | rat, chimp | | | | | | | (17/17) |
| 877 | Hum | CAAUGUUCAAUUCAGCAAG | CUUGCUGAAUUGAACAUUG | [2036-2054] | — | — | — | — |
| 878 | Hum | GGCUAUGGAGAUAUGGUUU | AAACCAUAUCUCCAUAGCC | [1835-1853] | — | — | — | — |
| 879 | Hum | AUAGGAAAUUAGUUCUGAG | CUCAGAACUAAUUUCCUAU | [1602-1620] | — | — | — | — |
| 880 | Hum | GAUAGGAAAUUAGUUCUGA | UCAGAACUAAUUUCCUAUC | [1601-1619] | — | — | — | — |
| 881 | Hum | AUAAACCAGAUUUGCCUAU | AUAGGCAAAUCUGGUUUAU | [1120-1138] | — | — | — | — |
| 882 | Hum | CAACAGUGAUUGAAGGGUC | GACCCUUCAAUCACUGUUG | [763-781] | — | — | — | — |
| 883 | Hum, chimp | UGGUUGCUCAAAGGUCCUU | AAGGACCUUUGAGCAACCA | [422-440] | [597-607] (11/11) | [478-488] (11/11) | [542-560] | [404-422] (18/19) |
| 884 | Hum, chimp | UUGGUUGCUCAAAGGUCCU | AGGACCUUUGAGCAACCAA | [421-439] | [597-607] (11/11) | [478-488] (11/11) | [541-559] | [403-421] (18/19) |
| 885 | Hum | AUGCUUACAAAAUGGUGAU | AUCACCAUUUUGUAAGCAU | [2486-2504] | — | — | — | — |
| 886 | Hum | CUGGAGUUGUCACCACUGA | UCAGUGGUGACAACUCCAG | [2387-2405] | — | — | — | — |
| 887 | Hum | CUCCAAAGGUUCACUGUGU | ACACAGUGAACCUUUGGAG | [2355-2373] | — | — | — | — |
| 888 | Hum, chimp | GAGGUAAUAUUUGAGGAAU | AUUCCUCAAAUAUUACCUC | [339-357] | — | — | [459-477] | [321-337] (16/17) |
| 889 | Hum, chimp | ACGAGGUAAUAUUUGAGGA | UCCUCAAAUAUUACCUCGU | [337-355] | — | — | [457-475] | [321-337] (16/17) |
| 890 | Hum | GUUCCUGACUCAAAUUUGA | UCAAAUUUGAGUCAGGAAC | [1251-1269] | — | — | — | — |
| 891 | Hum | CUGAUCCUCAGCUCAGGAU | AUCCUGAGCUGAGGAUCAG | [705-723] | [703-721] (18/19) | [584-602] (18/19) | — | — |
| 892 | Hum, chimp | AGGUAAUAUUUGAGGAAUC | GAUUCCUCAAAUAUUACCU | [340-358] | — | — | [460-478] | [322-337] (15/16) |
| 893 | Hum, chimp | CGAGGUAAUAUUUGAGGAA | UUCCUCAAAUAUUACCUCG | [338-356] | — | — | [458-476] | [321-337] (16/17) |
| 894 | Hum | AUCAAAACUUCCAAAAGCC | GGCUUUUGGAAGUUUUGAU | [1222-1240] | — | — | — | [1182-1200] (18/19) |
| 895 | Hum | UAUCAAAACUUCCAAAAGC | GCUUUUGGAAGUUUUGAUA | [1221-1239] | — | — | — | [1182-1199] (17/18) |
| 896 | Hum | CUGAUUUUCUGGCCUUUGG | CCAAAGGCCAGAAAAUCAG | [949-967] | — | — | — | — |
| 897 | Hum, chimp, dog | CACUGUGUUUAAGCAGGA | UCCUGCUUAAACACAAGUG | [613-631] | [613-629] (17/17) | — | [733-751] | [595-613] |
| 898 | Hum | UAUGCUUACAAAAUGGUGA | UCACCAUUUUGUAAGCAUA | [2485-2503] | — | — | — | — |
| 899 | Hum | GAAUUGAAGUAUCUCUCCU | AGGAGAGAUACUUCAAUUC | [1737-1755] | — | — | — | — |
| 900 | Hum | UUCCUGACUCAAAUUUGAA | UUCAAAUUUGAGUCAGGAA | [1252-1270] | — | — | — | — |
| 901 | Hum | UUCUCUAAGUUUUCAGAGG | CCUCUGAAAACUUAGAGAA | [1162-1180] | — | — | — | — |
| 902 | Hum | UGAAUGGGAUGGAAUAGGU | ACCUAUUCCAUCCCAUUCA | [1024-1042] | — | — | — | — |

TABLE A-continued

| | | | | 19 mer | | | | |
|---|---|---|---|---|---|---|---|---|
| No | Sp-Source | Sense siRNA | AntiSense siRNA | Hum 34222182 cds = 204-785 | Mouse 31541838 | rat 62644440 | chimp 55622975 | dog 74002279 |
| 903 | Hum | GAAGUGAUUCAAAAUAGUG | CACUAUUUUGAAUCACUUC | [969-987] | — | — | — | — |
| 904 | Hum | UUGAAGGGUCCUAAAAAGG | CCUUUUUAGGACCCUUCAA | [772-790] | — | — | — | — |
| 905 | Hum, rat | CGACUUGUUAAGAAAAAAC | GUUUUUUCUUAACAAGUCG | [726-744] | — | [605-623] | — | [708-724] (16/17) |
| 906 | Hum, chimp, dog | UUGUGUUUAAGCAGGAGAA | UUCUCCUGCUUAAACACAA | [616-634] | [614-631] (18/18) | — | [736-754] | [598-616] |
| 907 | Hum, chimp, dog | ACACUUGUGUUUAAGCAGG | CCUGCUUAAACACAAGUGU | [612-630] | [613-628] (16/16) | — | [732-750] | [594-612] |
| 908 | Hum, chimp | UUACACUUGUGUUUAAGCA | UGCUUAAACACAAGUGUAA | [610-628] | [613-626] (14/14) | — | [730-748] | [594-610] (17/17) |
| 909 | Hum, ms, rat, chimp | AGAAACUGACCCAGAGAAU | AUUCUCUGGGUCAGUUUCU | [448-466] | [446-464] | [327-345] | [568-586] | [430-445] (16/16) |
| 910 | Hum | CCAUGGCAGUGUUAUCUCA | UGAGAUAACACUGCCAUGG | [1701-1719] | — | — | — | — |
| 911 | Hum | AUUGAAGGGUCCUAAAAAG | CUUUUUAGGACCCUUCAAU | [771-789] | — | — | — | — |
| 912 | Hum | UGGAACAACAGUGAUUGAA | UUCAAUCACUGUUGUUCCA | [758-776] | — | — | — | [740-758] (18/19) |
| 913 | Hum, chimp, dog | GCAACUGGCAGUUUGAGCA | UGCUCAAACUGCCAGUUGC | [210-228] | [208-226] (18/19) | [89-107] (18/19) | [330-348] | [192-210] |
| 914 | Hum, chimp | GGUAAUAUUUGAGGAAUCA | UGAUUCCUCAAAUAUUACC | [341-359] | — | — | [461-479] | [327-337] (11/11) |
| 915 | Hum, ms, rat, chimp, dog | CUGAGAAACUGACCCAGAG | CUCUGGGUCAGUUUCUCAG | [445-463] | [443-461] | [324-342] | [565-583] | [427-445] |
| 916 | Hum | CUCUGGGCUUUUCUGGGAA | UUCCCAGAAAAGCCCAGAG | [1721-1739] | — | — | — | — |
| 917 | Hum | UUGGAACAACAGUGAUUGA | UCAAUCACUGUUGUUCCAA | [757-775] | — | — | — | [739-757] (18/19) |
| 918 | Hum | UGAUGGCUUAUGGAAGGCU | AGCCUUCCAUAAGCCAUCA | [2501-2519] | — | — | — | — |
| 919 | Hum | GUGAUGGCUUAUGGAAGGC | GCCUUCCAUAAGCCAUCAC | [2500-2518] | — | — | — | — |
| 920 | Hum | UUGGCUAUGGAGAUAUGGU | ACCAUAUCUCCAUAGCCAA | [1833-1851] | — | — | — | — |
| 921 | Hum | CUCUUUUCUUUCUGUGUUU | AAACACAGAAAGAAAAGAG | [902-920] | — | — | — | — |
| 922 | Hum | GGAACAACAGUGAUUGAAG | CUUCAAUCACUGUUGUUCC | [759-777] | — | — | — | [741-759] (18/19) |
| 923 | Hum | UCUCUGGGCUUUUCUGGGA | UCCCAGAAAAGCCCAGAGA | [1720-1738] | — | — | — | — |
| 924 | Hum | UCUCUUUUCUUUCUGUGUU | AACACAGAAAGAAAAGAGA | [901-919] | — | — | — | — |
| 925 | Hum | GUCUCUUUUCUUUCUGUGU | ACACAGAAAGAAAAGAGAC | [900-918] | — | — | — | — |

TABLE B additional 19 mers

| Number | Sense siRNA | AntiSense siRNA | Other Sp | Hum-34222182 ORF: 204-785 |
|---|---|---|---|---|
| 1 | CAGUGUUCUAACAAACUAA | UUAGUUUGUUAGAACACUG | | [2244-2262] 3'UTR |
| 2 | CCAGUGUUCUAACAAACUA | UAGUUUGUUAGAACACUGG | | [2243-2261] 3'UTR |
| 3 | GGCUUUUCUGGGAAUUGAA | UUCAAUUCCCAGAAAAGCC | | [1728-1744] 3'UTR |
| 4 | CGUGAACUUGGAAAUUGAA | UUCAAUUUCCAAGUUCACG | Dog, Chin, GP, Rat | [530-548] ORF |
| 5 | GGAUGGAAUAGGUAAGCAA | UUGCUUACCUAUUCCAUCC | | [1030-1048] 3'UTR |
| 6 | UAGCCAGUGUUCUAACAAA | UUUGUUAGAACACUGGCUA | | [2240-2258] 3'UTR |
| 7 | GAUUGAAGGGUCCUAAAAA | UUUUUAGGACCCUUCAAUC | | [770-788] ORF + 3'UTR |
| 8 | AGAAUUGGGCCAAGAUAAA | UUUAUCUUGGCCCAAUUCU | | [2306-2324] 3'UTR |
| 9 | UGCUGUGGGUCGUGGAUAA | UUAUCCACGACCCACAGCA | | [2068-2086] 3'UTR |
| 10 | AGGUAAGAGUAAAUGAGAA | UUCUCAUUUACUCUUACCU | | [1328-1346] 3'UTR |
| 11 | CUGUCCAAAUCAAAGCAAA | UUUGCUUUGAUUUGGACAG | Dog, Chimp | [396-414] ORF |
| 12 | UCAUGAUUGGGUAGUAAAA | UUUUACUACCCAAUCAUGA | | [811-829] 3'UTR |
| 13 | GCCAGUGUUCUAACAAACU | AGUUUGUUAGAACACUGGC | | [2242-2260] 3'UTR |
| 14 | GUGAUUGAAGGGUCCUAAA | UUUAGGACCCUUCAAUCAC | | [768-786] ORF + 3'UTR |
| 15 | GGAAGGCUGUUAAAUUAAU | AUUAAUUUAACAGCCUUCC | | [2512-2530] 3'UTR |
| 16 | GCUUAUGGAAGGCUGUUAA | UUAACAGCCUUCCAUAAGC | | [2506-2524] 3'UTR |
| 17 | UCCUGUUACUGAUACUAUA | UAUAGUAUCAGUAACAGGA | | [2194-2212] 3'UTR |
| 18 | GGUCCUUGUCCCUGAGAAA | UUUCUCAGGGACAAGGACC | Chimp | [434-452] ORF |
| 19 | UGGUUAAAAUGCUGGAGAA | UUCUCCAGCAUUUUAACCA | Chimp | [373-391] ORF |
| 20 | CCAUUGAGUGAAUGAUGAA | UUCAUCAUUCACUCAAUGG | | [1572-1590] 3'UTR |
| 21 | CAGGAUUUCGACUUGUUAA | UUAACAAGUCGAAAUCCUG | | [718-736] ORF |
| 22 | ACGUGAACUUGGAAAUUGA | UCAAUUUCCAAGUUCACGU | Dog, Chin, GP, Rat | [529-547] ORF |
| 23 | GUGUGAUCCUGUUACUGAU | AUCAGUAACAGGAUCACAC | | [2188-2206] 3'UTR |
| 24 | CGAGGUAAUAUUUGAGGAA | UUCCUCAAAUAUUACCUCG | Chimp | [338-356] ORF |
| 25 | GCUUGGAAAGAUACUACAA | UUGUAGUAUCUUUCCAAGC | | [2274-2292] 3'UTR |
| 26 | CUAAAAUGUCACUGUUCAA | UUGAACAGUGACAUUUUAG | | [2219-2237] 3'UTR |
| 27 | GUGACUUCCUCACUCUAAU | AUUAGAGUGAGGAAGUCAC | | [1385-1403] 3'UTR |
| 28 | GCCUGUUAUGCUUACAAAA | UUUUGUAAGCAUAACAGGC | | [2479-2497] 3'UTR |
| 29 | AGGUAGGCUUGGUAAUAGA | UCUAUUACCAAGCCUACCU | | [1097-1115] 3'UTR |
| 30 | GAUGAAUACCUGUGAGGAU | AUCCUCACAGGUAUUCAUC | | [1585-1603] 3'UTR |
| 31 | CUGUCACUAGGGAAUAAUA | UAUUAUUCCCUAGUGACAG | | [1929-1947] 3'UTR |
| 32 | GUUUUAAAGAGGCAACAAA | UUUGUUGCCUCUUUAAAAC | | [1404-1422] 3'UTR |
| 33 | GUGUUCUAACAAACUAAAC | GUUUAGUUUGUUAGAACAC | | [2246-2264] 3'UTR |
| 34 | GCUUGGUAAUAGACUAUAU | AUAUAGUCUAUUACCAAGC | | [1103-1121] 3'UTR |
| 35 | CAUCCUGGUGUUACUGAAA | UUUCAGUAACACCAGGAUG | | [2164-2182] 3'UTR |
| 36 | GCCUAUCAAAACUUCCAAA | UUUGGAAGUUUUGAUAGGC | | [1218-1236] 3'UTR |

TABLE B-continued additional 19 mers

| Number | Sense siRNA | AntiSense siRNA | Other Sp | Hum-34222182 ORF: 204-785 |
|---|---|---|---|---|
| 37 | UCCUGGUGUUACUGAAAAA | UUUUUCAGUAACACCAGGA | | [2166-2184] 3'UTR |
| 38 | CCACGGUGUUGUUUUAGAU | AUCUAAAACAACACCGUGG | | [1446-1464] 3'UTR |
| 39 | GCAGUUUGAGCAGCAAGAA | UUCUUGCUGCUCAAACUGC | Chimp | [217-235] ORF |
| 40 | CUUGGAAAGAUACUACAAA | UUUGUAGUAUCUUUCCAAG | | [2275-2293] 3'UTR |
| 41 | GUGUGAUUCUAGCGUCGUA | UACGACGCUAGAAUCACAC | | [578-596] ORF |
| 42 | CUUGGGCAUCGAUGUAGAA | UUCUACAUCGAUGCCCAAG | | [2419-2437] 3'UTR |
| 43 | GGGCUUUUCUGGGAAUUGA | UCAAUUCCCAGAAAAGCCC | | [1725-1743] 3'UTR |
| 44 | AACUGUCUGUCCAAAUCAA | UUGAUUUGGACAGACAGUU | Dog, Chimp | [390-408] ORF |
| 45 | AGCCAGUGUUCUAACAAAC | GUUUGUUAGAACACUGGCU | | [2241-2259] 3'UTR |
| 46 | GAAGGGUCCUAAAAAGGGA | UCCCUUUUUAGGACCCUUC | | [774-792] ORF + 3'UTR |
| 47 | AAAGCUUAACCCUAGGUAA | UUACCUAGGGUUAAGCUUU | | [1315-1333] 3'UTR |
| 48 | ACAUGUGCUUAAUCUCAGA | UCUGAGAUUAAGCACAUGU | | [1670-1688] 3'UTR |
| 49 | UCCUCACUCUAAUGUUUUA | UAAAACAUUAGAGUGAGGA | | [1391-1409] 3'UTR |
| 50 | GAAAGAUACUACAAAGCCA | UGGCUUUGUAGUAUCUUUC | | [2279-2297] 3'UTR |
| 51 | AAGGGUUUUUAGACAGGAA | UUCCUGUCUAAAAACCCUU | | [1269-1287] 3'UTR |
| 52 | UCAUCCUGGUGUUACUGAA | UUCAGUAACACCAGGAUGA | | [2163-2181] 3'UTR |
| 53 | CCUGUUACUGAUACUAUAA | UUAUAGUAUCAGUAACAGG | | [2195-2213] 3'UTR |
| 54 | CAUAGAUCCCAUUUUUGUA | UACAAAAUGGGAUCUAUG | | [999-1017] 3'UTR |
| 55 | AAUUGAAUGGGAUGGAAUA | UAUUCCAUCCCAUUCAAUU | | [1021-1039] 3'UTR |
| 56 | CUGUGAGGAUAGGAAAUUA | UAAUUUCCUAUCCUCACAG | | [1594-1612] 3'UTR |
| 57 | CCUAGGUAAGAGUAAAUGA | UCAUUUACUCUUACCUAGG | | [1325-1343] 3'UTR |
| 58 | CGUGGAUAAGGAGCUUAUU | AAUAAGCUCCUUAUCCACG | | [2078-2096] 3'UTR |
| 59 | CCAGAUUUGCCUAUUUUGA | UCAAAAUAGGCAAAUCUGG | | [1125-1143] 3'UTR |
| 60 | UUGGAGAAGUGAUUCAAAA | UUUUGAAUCACUUCUCCAA | | [964-982] 3'UTR |
| 61 | GAGGAAUCAACUUGCCAGA | UCUGGCAAGUUGAUUCCUC | Chimp | [351-389] ORF |
| 62 | GAGAAAUAUUACGGCAAUA | UAUUGCCGUAAUAUUUCUC | | [1342-1360] 3'UTR |
| 63 | AGAAUUGAAUGGGAUGGAA | UUCCAUCCCAUUCAAUUCU | | [1019-1037] 3'UTR |
| 64 | AUGGAAUAGGUAAGCAAAA | UUUUGCUUACCUAUUCCAU | | [1032-1050] 3'UTR |
| 65 | GUAAAAGCUGGAUAGGAU | AUCCUAUCCAGCUUUUUAC | Chin, GP, Chimp, Rat, Ms | [556-574] ORF |
| 66 | CCACCAGUUCCUGACUCAA | UUGAGUCAGGAACUGGUGG | | [1245-1263] 3'UTR |
| 67 | CAAAUUAGCCAGUGUUCUA | UAGAACACUGGCUAAUUUG | | [2235-2253] 3'UTR |
| 68 | CUCACUGAUUGGAACAACA | UGUUGUUCCAAUCAGUGAG | | [749-767] ORF |
| 69 | UGGAGAACUGUCUGUCCAA | UUGGACAGACAGUUCUCCA | Dog, GP, Chimp, Rat | [385-403] ORF |
| 70 | UAGAAUUGGGCCAAGAUAA | UUAUCUUGGCCCAAUUCUA | | [2305-2323] 3'UTR |
| 71 | CUCUUCAAAUGCUUGGAAA | UUUCCAAGCAUUUGAAGAG | | [2264-2282] 3'UTR |

TABLE B-continued additional 19 mers

| Number | Sense siRNA | AntiSense siRNA | Other Sp | Hum-34222182 ORF: 204-785 |
|---|---|---|---|---|
| 72 | UGUGGGUCGUGGAUAAGGA | UCCUUAUCCACGACCCACA | | [2071-2089] 3'UTR |
| 73 | CCUAAAAUGUCACUGUUCA | UGAACAGUGACAUUUUAGG | | [2218-2236] 3'UTR |
| 74 | UGAUUGAAGGGUCCUAAAA | UUUUAGGAGCCUUCAAUCA | | [769-787] ORF + 3'UTR |
| 75 | GAGAAACUGACCCAGAGAA | UUCUCUGGGUCAGUUUCUC | Chin, GP, Chimp, Rat, Ms | [447-465] ORF |
| 76 | CACCAGUUCCUGACUCAAA | UUUGAGUCAGGAACUGGUG | | [1246-1264] 3'UTR |
| 77 | CAAAGGUCCUUGUCCCUGA | UCAGGGACAAGGACCUUUG | Chimp | [430-448] ORF |
| 78 | GAGUGAAUGAUGAAUACCU | AGGUAUUCAUCAUUCACUC | | [1577-1595] 3'UTR |
| 79 | CAAUAAUGGAACUGCUUCA | UGAAGCAGUUCCAUUAUUG | | [1356-1374] 3'UTR |
| 80 | CACUAACAGUUAUCUUUGA | UCAAAGAUAACUGUUAGUG | | [2453-2471] 3'UTR |
| 81 | GCGUCGUACCUACUUUUGA | UCAAAAGUAGGUACGACGC | | [589-607] ORF |
| 82 | CGGCCAGCAUUUCAGAAUU | AAUUCUGAAAUGCUGGCCG | Chimp | [238-256] ORF |
| 83 | GUGCUUAAUCUCAGAUGAA | UUCAUCUGAGAUUAAGCAC | | [1674-1692] 3'UTR |
| 84 | GUUGUGUUAUGCACGUGAA | UUCACGUGCAUAACACAAC | Ms | [517-536] ORF |
| 85 | AGUACAGCCUAGAGAAUGA | UCAUUCUCUAGGCUGUACU | | [1856-1874] 3'UTR |
| 86 | ACUGUCUGUCCAAAUCAAA | UUUGAUUUGGACAGACAGU | Dog, Chimp | [391-409] ORF |
| 87 | AGCUUACACUUGUGUUUAA | UUAAACACAAGUGUAAGCU | Chimp | [607-625] ORF |
| 88 | GAUUGGGUAGUAAAACUAU | AUAGUUUUACUACCCAAUC | | [815-833] 3'UTR |
| 89 | GUGAACUUGGAAAUUGAAA | UUUCAAUUUCCAAGUUCAC | Dog, Chin, GP, Chimp, Rat | [531-549] ORF |
| 90 | GCCAGAAUUUGGUUAAAAU | AUUUUAACCAAAUUCUGGC | GP, Chimp, Rat, Ms | [364-382] ORF |
| 91 | CUGGCAGUUUGAGCAGCAA | UUGCUGCUCAAACUGCCAG | Chimp | [214-232] ORF |
| 92 | GAAUUGAAUGGGAUGGAAU | AUUCCAUCCCAUUCAAUUC | | [1020-1038] 3'UTR |
| 93 | GUCACUAGGGAAUAAUAAA | UUUAUUAUUCCCUAGUGAC | | [1931-1949] 3'UTR |
| 94 | AGAUCUAGUCCCUCUCUGA | UCAGAGAGGGACUAGAUCU | | [1619-1637] 3'UTR |
| 95 | UCUUGGGCAUCGAUGUAGA | UCUACAUCGAUGCCCAAGA | | [2418-2438] 3'UTR |
| 96 | CCAGAGAAUUGCUCAAGAU | AUCUUGAGCAAUUCUCUGG | Chimp, Ms | [458-476] ORF |
| 97 | CCCUGUUCUUAAGUGUUGA | UCAACACUUAAGAACAGGG | | [1485-1503] 3'UTR |
| 98 | GACCCAGAGAAUUGCUCAA | UUGAGCAAUUCUCUGGGUC | Chimp, Ms | [455-473] ORF |
| 99 | UUUGGAGAAGUGAUUCAAA | UUUGAAUCACUUCUCCAAA | | [963-981] 3'UTR |
| 100 | GUGAAUGAUGAAUACCUGU | ACAGGUAUUCAUCAUUCAC | | [1579-1597] 3'UTR |
| 101 | UCAGGAUUUCGACUUGUUA | UAACAAGUCGAAAUCCUGA | | [1717-735] ORF |
| 102 | AGUGAAUGAUGAAUACCUG | CAGGUAUUCAUCAUUCACU | | [1578-1596] 3'UTR |
| 103 | GACAGGAAGGUAGGAUUAA | UUAAUCCUACCUUCCUGUC | | [1280-1298] 3'UTR |
| 104 | GGGUCCUAAAAAGGGAAAA | UUUUCCCUUUUUAGGACCC | | [777-795] ORF + 3'UTR |
| 105 | GGAUAAGGAGCUUAUUCAG | CUGAAUAAGCUCCUUAUCC | | [2081-2099] 3'UTR |

TABLE B-continued additional 19 mers

| Number | Sense siRNA | AntiSense siRNA | Other Sp | Hum-34222182 ORF: 204-785 |
|---|---|---|---|---|
| 106 | CUUAUGGAAGGCUGUUAAA | UUUAACAGCCUUCCAUAAG | | [2507-2525] 3'UTR |
| 107 | CGAAGGAAACAGAGCCGUU | AACGGCUCUGUUUCCUUCG | Chimp | [181-199] 5'UTR |
| 108 | GUUCUAACAAACUAAACUC | GAGUUUAGUUUGUUAGAAC | | [2248-2266] 3'UTR |
| 109 | AAUGGGAUGGAAUAGGUAA | UUACCUAUUCCAUCCCAUU | | [1026-1044] 3'UTR |
| 110 | CCUGUUCUUAAGUGUUGAA | UUCAACACUUAAGAACAGG | | [1486-1504] 3'UTR |
| 111 | GGCCUUAUUUUUGUCUUA | UAAGACAAAAAUAAGGCC | | [1950-1968] 3'UTR |
| 112 | CUCUCUGAUUCACUUAGUA | UACUAAGUGAAUCAGAGAG | | [1630-1648] 3'UTR |
| 113 | GGCAGUUUGAGCAGCAAGA | UCUUGCUGCUCAAACUGCC | Chimp | [216-234] ORF |
| 114 | CGUCGUACCUACUUUUGAG | CUCAAAAGUAGGUACGAGG | | [590-608] ORF |
| 115 | GAAUGAAACUCACCGUCCA | UGGACGGUGAGUUUCAUUC | | [1869-1887] 3'UTR |
| 116 | GUCUAUUGUUAAGCUCCAA | UUGGAGCUUAACAAUAGAC | | [2342-2360] 3'UTR |
| 117 | CAACCUCAACGAGGUAAUA | UAUUACCUCGUUGAGGUUG | Chimp | [329-347] ORF |
| 118 | UAGGCUUGGUAAUAGACUA | UAGUCUAUUACCAAGCCUA | | [1100-1118] 3'UTR |
| 119 | GUAUGUAAAAGCUGGAUA | UAUCCAGCUUUUUACAUAC | Dog, Chimp, Ms | [552-570] ORF |
| 120 | GUUGCAACUGGCAGUUUGA | UCAAACUGCCAGUUGCAAC | Chimp | [207-225] ORF |
| 121 | CCUAGAGAAUGAAACUCAC | GUGAGUUUCAUUCUCUAGG | | [1863-1881] 3'UTR |
| 122 | GCCUGCUAAGUGAUUUUGA | UCAAAAUCACUUAGCAGGC | Chimp | [283-301] ORF |
| 123 | CUAUUAGCUCCACUUCACA | UGUGAAGUGGAGCUAAUAG | | [2114-2132] 3'UTR |
| 124 | AGUGAUUGAAGGGUCCUAA | UUAGGACCCUUCAAUCACU | | [767-785] ORF |
| 125 | GGGUAGUAGCUGUAUACUA | UAGUAUACAGCUACUACCC | | [1772-1790] 3'UTR |
| 126 | UGUUGUUUUGCAUGUCUAU | AUAGACAUGCAAAACAACA | | [2329-2347] 3'UTR |
| 127 | GUUCCUGACUCAAAUUUGA | UCAAAUUUGAGUCAGGAAC | | [1251-1269] 3'UTR |
| 128 | CAGUAACCACGGUGUUGUU | AACAACACCGUGGUUACUG | | [1440-1458] 3'UTR |
| 129 | AGAUUUUUCCACCUUGGA | UCCAAGGUGGAAAAAUCU | | [1907-1925] 3'UTR |
| 130 | CCCAGAGAAUUGCUCAAGA | UCUUGAGCAAUUCUCUGGG | Chimp, Ms | [457-475] ORF |
| 131 | CAGAUUUGCCUAUUUUGAU | AUCAAAAUAGGCAAAUCUG | | [1126-1144] 3'UTR |
| 132 | UGGAAGGCUGUUAAAUUAA | UUAAUUUAACAGCCUUCCA | | [2511-2529] 3'UTR |
| 133 | UAUAGUACAGCCUAGAGAA | UUCUCUAGGCUGUACUAUA | | [1853-1871] 3'UTR |
| 134 | GGUUGUGUUAUGCACGUGA | UCACGUGCAUAACACAACC | Ms | [516-534] ORF |
| 135 | GAUACCUGUCACUAGGGAA | UUCCCUAGUGACAGGUAUC | | [1924-1942] 3'UTR |
| 136 | CCUAUCAAAACUUCCAAAA | UUUUGGAAGUUUUGAUAGG | | [1219-1237] 3'UTR |
| 137 | GCGUAGGGACAGAUGUAUU | AAUACAUCUGUCCCUACGC | | [2145-2163] 3'UTR |
| 138 | GAUACUAUAAGUGACCUAA | UUAGGUCACUUAUAGUAUC | | [2204-2222] 3'UTR |
| 139 | CGAAGUCUGCAUUGGCUAU | AUAGCCAAUGCAGACUUCG | | [1822-1840] 3'UTR |
| 140 | GGAUAGGAUUGUGUGUGAU | AUCACACACAAUCCUAUCC | Chin, GP, Chimp, Rat | [566-584] ORF |
| 141 | GGCCUUUGGAGAAGUGAUU | AAUCACUUCUCCAAAGGCC | | [959-977] 3'UTR |

TABLE B-continued additional 19 mers

| Number | Sense siRNA | AntiSense siRNA | Other Sp | Hum-34222182 ORF: 204-785 |
|---|---|---|---|---|
| 142 | AUAGGUAAGCAAAAGUAGA | UCUACUUUUGCUUACCUAU | | [1037-1055] 3'UTR |
| 143 | GGUAGGAUUAAGUAGGUGA | UCACCUACUUAAUCCUACC | | [1288-1306] 3'UTR |
| 144 | GAUUAAGUAGGUGAGUUUA | UAAACUCACCUACUUAAUC | | [1293-1311] 3'UTR |
| 145 | AGGAAGGUAGGAUUAAGUA | UACUUAAUCCUACCUUCCU | | [1283-1301] 3'UTR |
| 146 | GGUGUGAUCCUGUUACUGA | UCAGUAACAGGAUCACACC | | [2187-2205] 3'UTR |
| 147 | CAUGGACUAGCUUCAGGGA | UCCCUGAAGCUAGUCCAUG | Dog, Chimp | [640-658] ORF |
| 148 | GAAGGGUUUUUAGACAGGA | UCCUGUCUAAAAACCCUUC | | [1268-1286] 3'UTR |
| 149 | CUUUGGAGAAGUGAUUCAA | UUGAAUCACUUCUCCAAAG | | [962-980] 3'UTR |
| 150 | UGGAGAAGUGAUUCAAAAU | AUUUUGAAUCACUUCUCCA | | [965-983] 3'UTR |
| 151 | CAGUGAUUGAAGGGUCCUA | UAGGACCCUUCAAUCACUG | | [766-784] ORF |
| 152 | UGUACAGAAUUGAAUGGGA | UCCCAUUCAAUUCUGUACA | | [1014-1032] 3'UTR |
| 153 | UCAACGAGGUAAUAUUUGA | UCAAAUAUUACCUCGUUGA | Chimp | [334-352] ORF |
| 154 | CUCUGGGCUUUUCUGGGAA | UUGCGAGAAAAGCCCAGAG | | [1721-1739] 3'UTR |
| 155 | GGCUUGCGAGGUUGUGUUA | UAACACAACCUCGCAAGCC | Chimp | [507-525] ORF |
| 156 | CGGCAAUAAUGGAACUGCU | AGCAGUUCCAUUAUUGCCG | | [1353-1371] 3'UTR |
| 157 | CUUUACUCACUGAUUGGAA | UUCCAAUCAGUGAGUAAAG | | [744-762] ORF |
| 158 | GGACUUUUUCUUUAGUAGA | UCUACUAAAGAAAAAGUCC | | [658-674] ORF |
| 159 | CUCUGAUUCACUUAGUAAU | AUUACUAAGUGAAUCAGAG | | [1632-1650] 3'UTR |
| 160 | GUACAGAAUUGAAUGGGAU | AUCCCAUUCAAUUCUGUAC | | [1015-1033] 3'UTR |
| 161 | GGGAAUAAUAAAGGCCUUA | UAAGGCCUUUAUUAUUCCC | | [1938-1956] 3'UTR |
| 162 | UACCUGUGAGGAUAGGAAA | UUUCCUAUCCUCACAGGUA | | [1591-1609] 3'UTR |
| 163 | GGAUACCUGUCACUAGGGA | UCCCUAGUGACAGGUAUCC | | [1923-1941] 3'UTR |
| 164 | CUAGCUUCAGGGACUUUUU | AAAAAGUCCCUGAAGCUAG | Chimp | [646-664] ORF |
| 165 | AAAGAUACUACAAAGCCAA | UUGGCUUUGUAGUAUCUUU | | [2280-2298] 3'UTR |
| 166 | UGUGGUGCCAUUUCAGUAA | UUACUGAAAUGGCACCACA | | [1427-1445] 3'UTR |
| 167 | AUAGAAUUGGGCCAAGAUA | UAUCUUGGCCCAAUUCUAU | | [2304-2322] 3'UTR |
| 168 | GUUUCAGGUAGGCUGGUA | UACCAAGCCUACCUGAAAC | | [1092-1110] 3'UTR |
| 169 | GGUCGUGGAUAAGGAGCUU | AAGCUCCUUAUCCACGACC | | [2075-2093] 3'UTR |
| 170 | AAUGGUGAUGGCUUAUGGA | UCCAUAAGCCAUCACCAUU | | [2496-2514] 3'UTR |
| 171 | GCUUGUGGUGCCAUUUCAG | CUGAAAUGGCACCACAAGC | | [1424-1442] 3'UTR |
| 172 | UGUGCUUAAUCUCAGAUGA | UCAUCUGAGAUUAAGCACA | | [1673-1691] 3'UTR |
| 173 | UAGGUAAGCAAAAGUAGAA | UUCUACUUUUGCUUACCUA | | [1038-1056] 3'UTR |
| 174 | UGAUUUCUGGCCUUUGGA | UCCAAAGGCCAGAAAUCA | | [950-968] 3'UTR |
| 175 | GCUUCUUGGGCAUCGAUGU | ACAUCGAUGCCCAAGAAGC | | [2415-2433] 3'UTR |
| 176 | CCGUCCAGAUAACCAUGCA | UGCAUGGUUAUCUGGACGG | | [1881-1899] 3'UTR |
| 177 | AACCAUGCAUGCACCCAGA | UCUGGGUGCAUGCAUGGUU | | [1891-1909] 3'UTR |
| 178 | CAGGAAGGUAGGAUUAAGU | ACUUAAUCCUACCUUCCUG | | [1282-1300] 3'UTR |

TABLE B-continued additional 19 mers

| Number | Sense siRNA | AntiSense siRNA | Other Sp | Hum-34222182 ORF: 204-785 |
|---|---|---|---|---|
| 179 | GAAUUGGGCCAAGAUAAAU | AUUUAUCUUGGCCCAAUUC | | [2307-2325] 3'UTR |
| 180 | GUGAGGAUAGGAAAUUAGU | ACUAAUUUCCUAUCCUCAC | | [1596-1614] 3'UTR |
| 181 | GAUUUUUCCACCUUGGAU | AUCCAAGGUGGAAAAAAUC | | [1908-1926] 3'UTR |
| 182 | GCAUGCACCCAGAUUUUUU | AAAAAAUCUGGGUGCAUGC | | [1897-1915] 3'UTR |
| 183 | CCUGCUAAGUGAUUUUGAC | GUCAAAAUCACUUAGCAGG | Chimp | [284-302] ORF |
| 184 | GGGAUUAUGUUGUUCCUGA | UCAGGAACAACAUAAUCCC | Chimp | [307-325] ORF |
| 185 | UGCCUGUUAUGCUUACAAA | UUUGUAAGCAUAACAGGCA | | [2478-2496] 3'UTR |
| 186 | CCACCUUGGAUACCUGUCA | UGACAGGUAUCCAAGGUGG | | [1916-1934] 3'UTR |
| 187 | UGGCCUUUGGAGAAGUGAU | AUCACUUCUCCAAAGGCCA | | [958-976] 3'UTR |
| 188 | CUGCAUAGAUCCCAUUUUU | AAAAAUGGGAUCUAUGCAG | | [996-1014] 3'UTR |
| 189 | CCAACCUCAACGAGGUAAU | AUUACCUCGUUGAGGUUGG | Chimp | [328-346] ORF |
| 190 | AGAAACUGACCCAGAGAAU | AUUCUCUGGGUCAGUUUCU | Chin, GP, Chimp, Rat, Ms | [448-466] ORF |
| 191 | UGGUGACUUCCUCACUCUA | UAGAGUGAGGAAGUCACCA | | [1383-1401] 3'UTR |
| 192 | AGGGAAUAAUAAAGGCCUU | AAGGCCUUUAUUAUUCCCU | | [1937-1955] 3'UTR |
| 193 | CCUGUUAUGCUUACAAAAU | AUUUUGUAAGCAUAACAGG | | [2480-2498] 3'UTR |
| 194 | AAAGUAGAAGCCCAUUUGA | UCAAAUGGGCUUCUACUUU | | [1048-1066] 3'UTR |
| 195 | GAUUUUGACUACUGGGAUU | AAUCCCAGUAGUCAAAAUC | Dog, Chimp | [294-312] ORF |
| 196 | GGCUUAUGGAAGGCUGUUA | UAACAGCCUUCCAUAAGCC | | [2505-2523] 3'UTR |
| 197 | UGUUGUCCUUUUUCCACUA | UAGUGGAAAAAGGACAACA | | [2439-2457] 3'UTR |
| 198 | GGCGUAGGGACAGAUGUAU | AUACAUCUGUCCCUACGCC | | [2144-2162] 3'UTR |
| 199 | AGUGUAGAUUUUCUGCAUA | UAUGCAGAAAAUCUACACU | | [984-1002] 3'UTR |
| 200 | CCUUGGAUACCUGUCACUA | UAGUGACAGGUAUCCAAGG | | [1919-1937] 3'UTR |
| 201 | CCAGAUUUUUCCACCUUG | CAAGGUGGAAAAAUCUGG | | [1905-1923] 3'UTR |
| 202 | UAGGUAAGAGUAAAUGAGA | UCUCAUUUACUCUUACCUA | | [1327-1345] 3'UTR |
| 203 | ACCUGCCCUAAAUAAGAAA | UUUCUUAUUUAGGGCAGGU | | [870-888] 3'UTR |
| 204 | UGAGGAUAGGAAAUUAGUU | AACUAAUUUCCUAUCCUCA | | [1597-1615] 3'UTR |
| 205 | GGCUUUUUUUCUCUAAGU | ACUUAGAGAAAAAAAGCC | | [1153-1171] 3'UTR |
| 206 | AAGGGUCCUAAAAGGGAA | UUCCCUUUUAGGACCCUU | | [775-793] ORF + 3'UTR |
| 207 | UAUGCACGUGAACUUGGAA | UUCCAAGUUCACGUGCAUA | Dog, Chin, GP, Rat | [524-542] ORF |
| 208 | GGCUUGGUAAUAGACUAUA | UAUAGUCUAUUACCAAGCC | | [1102-1120] 3'UTR |
| 209 | CGUUGACCAUGGUUGCAAC | GUUGCAACCAUGGUCAACG | Chimp, Rat, Ms | [196-214] 5'UTR + ORF |
| 210 | UGUCUAUUGUUAAGCUCCA | UGGAGCUUAACAAUAGACA | | [2341-2359] 3'UTR |
| 211 | GCAUAGAUCCCAUUUUUGU | ACAAAAAUGGGAUCUAUGC | | [998-1016] 3'UTR |
| 212 | CAAUUUACGAAGUCUGCAU | AUGCAGACUUCGUAAAUUG | | [1815-1833] 3'UTR |
| 213 | GGAAUAGGUAAGCAAAAGU | ACUUUUGCUUACCUAUUCC | | [1034-1052] 3'UTR |

TABLE B-continued additional 19 mers

| Number | Sense siRNA | AntiSense siRNA | Other Sp | Hum-34222182 ORF: 204-785 |
|---|---|---|---|---|
| 214 | UCAGCUAAAGUCAUUUGUA | UACAAAUGACUUUAGCUGA | | [842-860] 3'UTR |
| 215 | GCUGGAUAGGAUUGUGUGU | ACACACAAUCCUAUCCAGC | Chin, GP, Chimp, Rat | [563-581] ORF |
| 216 | GGAAGGUAGGAUUAAGUAG | CUACUUAAUCCUACCUUCC | | [1284-1302] 3'UTR |
| 217 | GUACAGCCUAGAGAAUGAA | UUCAUUCUCUAGGCUGUAC | | [1857-1875] 3'UTR |
| 218 | GAUUCUAGCGUCGUACCUA | UAGGUACGACGCUAGAAUC | | [582-600] ORF |
| 219 | GAUCUAGUCCCUCUCUGAU | AUCAGAGAGGGACUAGAUC | | [1620-1638] 3'UTR |
| 220 | GACUCAAAUGUGAAGGGUU | AACCCUUCAAAUUUGAGUC | | [1257-1275] 3'UTR |
| 221 | UCCACUCAACAAUGUUCAA | UUGAACAUUGUUGAGUGGA | | [2027-2045] 3'UTR |
| 222 | UGUAGAUUUCUGCAUAGA | UCUAUGCAGAAAAUCUACA | | [986-1004] 3'UTR |
| 223 | UCGUGGAUAAGGAGCUUAU | AUAAGCUCCUUAUCCACGA | | [2077-2095] 3'UTR |
| 224 | UGGAGAUAUGGUUUAUAGU | ACUAUAAACCAUAUCUCCA | | [1840-1858] 3'UTR |
| 225 | GUAUACUACCACUUUGAAU | AUUCAAAGUGGUAGUAUAC | | [1783-1801] 3'UTR |
| 226 | CCGUUGACCAUGGUUGCAA | UUGCAACCAUGGUCAACGG | Chimp, Rat, Ms | [195-213] 5'UTR + ORF |
| 227 | GGGAUGGAAUAGGUAAGCA | UGCUUACCUAUUCCAUCCC | | [1029-1047] 3'UTR |
| 228 | GAAUUAUUGAAACGGGUCA | UGACCCGUUUCAAUAAUUC | | [1798-1816] 3'UTR |
| 229 | CUAUGGAGAUAUGGUUUAU | AUAAACCAUAUCUCCAUAG | | [1837-1855] 3'UTR |
| 230 | CCUUUGGAGAAGUGAUUCA | UGAAUCACUUCUCCAAAGG | | [961-979] 3'UTR |
| 231 | AGCCCAUUUGAGUUUUACA | UGUAAAACUCAAAUGGGCU | | [1056-1074] 3'UTR |
| 232 | AGGAUUGUGUGUGAUUCUA | UAGAAUCACACACAAUCCU | Chimp | [570-588] ORF |
| 233 | UGCUUGGAAAGAUACUACA | UGUAGUAUCUUUCCAAGCA | | [2273-2291] 3'UTR |
| 234 | ACCAGUUCCUGACUCAAAU | AUUUGAGUCAGGAACUGGU | | [1247-1265] 3'UTR |
| 235 | GGCUAUGGAGAUAUGGUUU | AAACCAUAUCUCCAUAGCC | | [1836-1853] 3'UTR |
| 236 | CUUUUCCACUAACAGUUA | UAACUGUUAGUGGAAAAAG | | [2446-2464] 3'UTR |
| 237 | CCCAGAUUUUUUCCACCUU | AAGGUGGAAAAAAUCUGGG | | [1904-1922] 3'UTR |
| 238 | GGUCCUAAAAAGGGAAAAU | AUUUUCCCUUUUUAGGACC | | [778-796] ORF + 3'UTR |
| 239 | GCUUCAGGGACUUUUUCUU | AAGAAAAAGUCCCUGAAGC | Chimp | [649-687] ORF |
| 240 | UGUUUUAAAGAGGCAACAA | UUGUUGCCUCUUUAAAACA | | [1403-1421] 3'UTR |
| 241 | GGAAUAAUAAAGGCCUUAU | AUAAGGCCUUUAUUAUUCC | | [1939-1957] 3'UTR |
| 242 | GCAUGUCUAUUGUUAAGCU | AGCUUAACAAUAGACAUGC | | [2338-2356] 3'UTR |
| 243 | AGGUCCUUGUCCCUGAGAA | UUCUCAGGGACAAGGACCU | Chimp | [433-451] ORF |
| 244 | UGAUGAAUACCUGUGAGGA | UCCUCACAGGUAUUCAUCA | | [1584-1602] 3'UTR |
| 245 | CUGUAUACUACCACUUUGA | UCAAAGUGGUAGUAUACAG | | [1781-1799] 3'UTR |
| 246 | GUAGAUUUUCUGCAUAGAU | AUCUAUGCAGAAAAUCUAC | | [967-1005] 3'UTR |
| 247 | UUAUGCACGUGAACUUGGA | UCCAAGUUCACGUGCAUAA | Dog, Chin, GP, Rat, Ms | [523-541] ORF |

TABLE B-continued additional 19 mers

| Number | Sense siRNA | AntiSense siRNA | Other Sp | Hum-34222182 ORF: 204-785 |
|---|---|---|---|---|
| 248 | GAAACUGACCCAGAGAAUU | AAUUCUCUGGGUCAGUUUC | Chin, GP, Chimp, Rat, Ms | [449-467] ORF |
| 249 | CCAGUUCCUGACUCAAAUU | AAUUUGAGUCAGGAACUGG | | [1248-1266] 3'UTR |
| 250 | GAAACAGAGCCGUUGACCA | UGGUCAACGGCUCUGUUUC | Dog, Chimp, Rat, Ms | [186-204] 5'UTR |
| 251 | GAGAACUGUCUGUCCAAAU | AUUUGGACAGACAGUUCUC | Dog, Chimp | [387-405] ORF |
| 252 | UGUCACUAGGGAAUAAUAA | UUAUUAUUCCCUAGUGACA | | [1930-1948] 3'UTR |
| 253 | CAUUGAGUGAAUGAUGAAU | AUUCAUCAUUCACUCAAUG | | [573-1591] 3'UTR |
| 254 | UACAGCCUAGAGAAUGAAA | UUUCAUUCUCUAGGCUGUA | | [1858-1876] 3'UTR |
| 255 | GGAGAACUCUGAUCCUCAG | CUGAGGAUCAGAGUUCUCC | | [697-715] ORF |
| 256 | ACGAGGUAAUAUUUGAGGA | UCCUCAAAUAUUACCUCGU | Chimp | [337-355] ORF |
| 257 | CAGGGACUUUUCUUUAGU | ACUAAAGAAAAGUCCCUG | | [653-671] ORF |
| 258 | AGUUGAUUACUCUUCCAUU | AAUGGAAGAGUAAUCAACU | | [1558-1576] 3'UTR |
| 259 | GGAACAACAGUGAUUGAAG | CUUCAAUCACUGUUGUUCC | | [759-777] ORF |
| 260 | AAGGAAACAGAGCCGUUGA | UCAACGGCUCUGUUUCCUU | Chimp | [183-201] 5'UTR |
| 261 | CAAAGCCAAUCUUUAUAGA | UCUAUAAAGAUUGGCUUUG | | [2290-2308] 3'UTR |
| 262 | AAACGGGUCAAUUUACGAA | UUCGUAAAUUGACCCGUUU | | [1807-1825] 3'UTR |
| 263 | AAGGCUUCUUGGGCAUCGA | UCGAUGCCCAAGAAGCCUU | | [2412-2430] 3'UTR |
| 264 | CCUGAGAAACUGACCCAGA | UCUGGGUCAGUUUCUCAGG | Dog, Chin, GP, Chimp, Ms | [444-462] ORF |
| 265 | CUGCAUUGGCUAUGGAGAU | AUCUCCAUAGCCAAUGCAG | | [1828-1846] 3'UTR |
| 266 | GAUUGUGUGUGAUUCUAGC | GCUAGAAUCACACACAAUC | | [572-59] ORF |
| 267 | GCUAGUCAGCUAAAGUCAU | AUGACUUUAGCUGACUAGC | | [837-855] 3'UTR |
| 268 | UAUUCAUCCUGGUGUUACU | AGUAACACCAGGAUGAAUA | | [2160-2178] 3'UTR |
| 269 | GGGUAGUAAAACUAUUCAG | CUGAAUAGUUUUACUACCC | | [819-837] 3'UTR |
| 270 | ACCACGGUGUUGUUUUAGA | UCUAAAACAACACCGUGGU | | [1445-1463] 3'UTR |
| 271 | CAGUUAUCUUUGACUCUCU | AGAGAGUCAAAGAUAACUG | | [2459-2477] 3'UTR |
| 272 | CACAAUUUGGUUUCAGGUA | UACCUGAAACCAAAUUGUG | | [1083-1101] 3'UTR |
| 273 | UGAUUGGGUAGUAAAACUA | UAGUUUUACUACCCAAUCA | | [814-832] 3'UTR |
| 274 | CUUCUUGGGCAUCGAUGUA | UACAUCGAUGCCCAAGAAG | | [2416-2434] 3'UTR |
| 275 | GCUUUUCUGGGAAUUGAAG | CUUCAAUUCCCAGAAAAGC | | [1727-1745] 3'UTR |
| 276 | GGAUUGUGUGUGAUUCUAG | CUAGAAUCACACACAAUCC | Chimp | [571-589] ORF |
| 277 | AGUCUGCAUUGGCUAUGGA | UCCAUAGCCAAUGCAGACU | | [1825-1843] 3'UTR |
| 278 | ACUACAAAGCCAAUCUUUA | UAAAGAUUGGCUUUGUAGU | | [2286-2304] 3'UTR |
| 279 | UAGUGUAGAUUUCUGCAU | AUGCAGAAAAUCUACACUA | | [983-1001] 3'UTR |
| 280 | GCAAAAGUAGAAGCCCAUU | AAUGGGCUUCUACUUUUGC | | [1045-1063] 3'UTR |
| 281 | GGGUCAAUUUACGAAGUCU | AGACUUCGUAAAUUGACCC | | [1811-1829] 3'UTR |
| 282 | AGGCUUCUUGGGCAUCGAU | AUCGAUGCCCAAGAAGCCU | | [2413-2431] 3'UTR |

TABLE B-continued additional 19 mers

| Number | Sense siRNA | AntiSense siRNA | Other Sp | Hum-34222182 ORF: 204-785 |
|---|---|---|---|---|
| 283 | UGAUUGGAACAACAGUGAU | AUCACUGUUGUUCCAAUCA | | [754-772] ORF |
| 284 | AAUUCAGCAAGGCUUUCAU | AUGAAAGCCUUGCUGAAUU | | [2044-2062] 3'UTR |
| 285 | AAUGAUGAAUACCUGUGAG | CUCACAGGUAUUCAUCAUU | | [1582-1600] 3'UTR |
| 286 | AUACCUGUGAGGAUAGGAA | UUCCUAUCCUCACAGGUAU | | [1590-1608] 3'UTR |
| 287 | UUCAUGAUUGGGUAGUAAA | UUUACUACCCAAUCAUGAA | | [810-828] 3'UTR |
| 288 | CUACAAAGCCAAUCUUUAU | AUAAAGAUUGGCUUUGUAG | | [2287-2305] 3'UTR |
| 289 | GAGCCUGCUAAGUGAUUUU | AAAAUCACUUAGCAGGCUC | Chimp | [281-299] ORF |
| 290 | AACCCUAGGUAAGAGUAAA | UUUACUCUUACCUAGGGUU | | [1322-1340] 3'UTR |
| 291 | UAACCCUAGGUAAGAGUAA | UUACUCUUACCUAGGGUUA | | [1321-1339] 3'UTR |
| 292 | CAAAAUGGUGAUGGCUUAU | AUAAGCCAUCACCAUUUUG | | [2493-2511] 3'UTR |
| 293 | UUAGCCAGUGUUCUAACAA | UUGUUAGAACACUGGCUAA | | [2239-2257] 3'UTR |
| 294 | AACUGUUGUCCUUUUUCCA | UGGAAAAAGGACAACAGUU | | [2436-2454] 3'UTR |
| 295 | GCAUUCAGAAUUGCUGGA | UCCAGCAAUUCUGAAAUGC | Chimp | [244-262] ORF |
| 296 | GUACCUACUUUUGAGCUUA | UAAGCUCAAAAGUAGGUAC | | [594-812] ORF |
| 297 | CUGUCUGUCCAAAUCAAAG | CUUUGAUUUGGACAGACAG | Dog, Chimp | [392-410] ORF |
| 298 | GUCUUAUUCCAACUAAGUA | UACUUAGUUGGAAUAAGAC | | [1963-1981] 3'UTR |
| 299 | UUGUGUUUAAGCAGGAGAA | UUCUCCUGCUUAAACACAA | Dog, Chimp | [616-634] ORF |
| 300 | UGCCAGAAUUUGGUUAAAA | UUUUAACCAAAUUCUGGCA | GP, Chimp, Rat, Ms | [363-381] ORF |
| 301 | CUAAUGUUUAAAGAGGCA | UGCCUCUUUAAACAUUAG | | [1399-1417] 3'UTR |
| 302 | CUAAGUUUUCAGAGGAUUU | AAAUCCUCUGAAAACUUAG | | [1166-1184] 3'UTR |
| 303 | GGUUUAUAGUACAGCCUAG | CUAGGCUGUACUAUAAACC | | [1849-1867] 3'UTR |
| 304 | ACAGGAAGGUAGGAUUAAG | CUUAAUCCUACCUUCCUGU | | [1281-1299] 3'UTR |
| 305 | UCCUCUGGUUUCAGGAGAA | UUCUCCUGAAACCAGAGGA | | [684-702] ORF |
| 306 | UGUUGUUUUAGAUGCCUUU | AAAGGCAUCUAAAACAACA | | [1452-1470] 3'UTR |
| 307 | UCUCUGAUUCACUUAGUAA | UUACUAAGUGAAUCAGAGA | | [1631-1649] 3'UTR |
| 308 | UGAUUUUGACUACUGGGAU | AUCCCAGUAGUCAAAAUCA | Dog, Chimp | [293-311] ORF |
| 309 | AGAGAGCCUGCUAAGUGAU | AUCACUUAGCAGGCUCUCU | Chimp | [278-296] ORF |
| 310 | GGUGAUGGCUUAUGGAAGG | CCUUCCAUAAGCCAUCACC | | [2499-2517] 3'UTR |
| 311 | UGUCAAGGGUAGUAGCUGU | ACAGCUACUACCCUUGACA | | [1766-1784] 3'UTR |
| 312 | CGCUUCUCCUCUGGUUUCA | UGAAACCAGAGGAGAAGCG | | [678-698] ORF |
| 313 | AUGUUGUUUUGCAUGUCUA | UAGACAUGCAAAACAACAU | | [2328-2346] 3'UTR |
| 314 | CUAGCGUCGUACCUACUUU | AAAGUAGGUACGACGCUAG | | [586-604] ORF |
| 315 | CCAGAUAACCAUGCAUGCA | UGCAUGCAUGGUUAUCUGG | | [1885-1903] 3'UTR |
| 316 | CUUCCAAAAGCCCACACCA | UGGUGUGGGCUUUUGGAAG | | [1229-1247] 3'UTR |
| 317 | AGUUAUCUUUGACUCUCUU | AAGAGAGUCAAAGAUAACU | | [2460-2478] 3'UTR |
| 318 | CUUAAGUGUUGAAUACUGU | ACAGUAUUCAACACUUAAG | | [1492-1510] 3'UTR |
| 319 | CAUAGCAACUGCAGCUAAC | GUUAGCUGCAGUUGCUAUG | | [927-945] 3'UTR |

TABLE B-continued additional 19 mers

| Number | Sense siRNA | AntiSense siRNA | Other Sp | Hum-34222182 ORF: 204-785 |
|---|---|---|---|---|
| 320 | CCGGCCAGCAUUUCAGAAU | AUUCUGAAAUGCUGGCCGG | Chimp | [237-255] ORF |
| 321 | GGCCAAGAUAAAUCAAUGU | ACAUUGAUUUAUCUUGGCC | | [2313-2331] 3'UTR |
| 322 | AUAUUACGGCAAUAAUGGA | UCCAUUAUUGCCGUAAUAU | | [1347-1365] 3'UTR |
| 323 | ACUUCCUCACUCUAAUGUU | AACAUUAGAGUGAGGAAGU | | [1388-1406] 3'UTR |
| 324 | UAAAAAGCUGGAUAGGAUU | AAUCCUAUCCAGCUUUUUA | Chin, GP, Chimp, Rat | [557-575] ORF |
| 325 | AUGUUGUUCCUGAACCCAA | UUGGGUUCAGGAACAACAU | Chimp | [313-331] ORF |
| 326 | GGUUUCAGGAGAACUCUGA | UCAGAGUUCUCCUGAAACC | | [690-708] ORF |
| 327 | CAUGGUUGCAACUGGCAGU | ACUGCCAGUUGCAACCAUG | Chimp | [203-221] 5'UTR + ORF |
| 328 | UUUCAGGUAGGCUUGGUAA | UUACCAAGCCUACCUGAAA | | [1093-1111] 3'UTR |
| 329 | UGUGAUCCUGUUACUGAUA | UAUCAGUAACAGGAUCACA | | [2189-2207] 3'UTR |
| 330 | UUUCAUGAUUGGGUAGUAA | UUACUACCCAAUCAUGAAA | | [809-827] 3'UTR |
| 331 | GUUUUUAGACAGGAAGGUA | UACCUUCCUGUCUAAAAAC | | [1273-1291] 3'UTR |
| 332 | AGGUUUCCUGCCCUAGCUA | UAGCUAGGGCAGGAAACCU | | [2098-2116] 3'UTR |
| 333 | CAACAAUGUUCAAUUCAGC | GCUGAAUUGAACAUUGUUG | | [2033-2051] 3'UTR |
| 334 | CCUCUUUUCAGUAUUACAU | AUGUAAUACUGAAAAGAGG | | [1655-1673] 3'UTR |
| 335 | GUCAAGGGUAGUAGCUGUA | UACAGCUACUACCCUUGAC | | [1767-1785] 3'UTR |
| 336 | AGUGUUGAAUACUGUCUUU | AAAGACAGUAUUCAACACU | | [1496-1514] 3'UTR |
| 337 | GAACAACAGUGAUUGAAGG | CCUUCAAUCACUGUUGUUC | | [760-778] ORF |
| 338 | UCCUCUUUUCAGUAUUACA | UGUAAUACUGAAAAGAGGA | | [1654-1672] 3'UTR |
| 339 | AGGAAUCAACUUGCCAGAA | UUCUGGCAAGUUGAUUCCU | Chimp | [352-370] ORF |
| 340 | CGUCCAGAUAACCAUGCAU | AUGCAUGGUUAUCUGGACG | | [1882-1900] 3'UTR |
| 341 | CCUUUUUCCACUAACAGUU | AACUGUUAGUGGAAAAAGG | | [2445-2463] 3'UTR |
| 342 | CAGAAUUGAAUGGGAUGGA | UCCAUCCCAUUCAAUUCUG | | [1018-1036] 3'UTR |
| 343 | UUUUCUGGCCUUUGGAGAA | UUCUCCAAAGGCCAGAAAA | | [953-971] 3'UTR |
| 344 | CCUCUCUGAUUCACUUAGU | ACUAAGUGAAUCAGAGAGG | | [1629-1647] 3'UTR |
| 345 | GUCCCUCUCUGAUUCACUU | AAGUGAAUCAGAGAGGGAC | | [1626-1644] 3'UTR |
| 346 | AGGGUCCUAAAAAGGGAAA | UUUCCCUUUUUAGGACCCU | | [776-794] ORF + 3'UTR |
| 347 | UAUAGAAUUGGGCCAAGAU | AUCUUGGCCCAAUUCUAUA | | [2303-2321] 3'UTR |
| 348 | GUUUCAGGAGAACUCUGAU | AUCAGAGUUCUCCUGAAAC | | [691-709] ORF |
| 349 | GCUAUUAGCUCCACUUCAC | GUGAAGUGGAGCUAAUAGC | | [2113-2131] 3'UTR |
| 350 | UGGGCCAAGAUAAAUCAAU | AUUGAUUUAUCUUGGCCCA | | [2311-2329] 3'UTR |
| 351 | ACUCAAAUUUGAAGGGUUU | AAACCCUUCAAAUUUGAGU | | [1258-1276] 3'UTR |
| 352 | CUAACAGGCUGAUUUUCUG | CAGAAAAUCAGCCUGUUAG | | [941-959] 3'UTR |
| 353 | CAAUGUUCAAUUCAGCAAG | CUUGCUGAAUUGAACAUUG | | [2036-2054] 3'UTR |
| 354 | UGGUGUUACUGAAAAACAG | CUGUUUUUCAGUAACACCA | | [2169-2187] 3'UTR |
| 355 | GUUCCUGAACCCAACCUCA | UGAGGUUGGGUUCAGGAAC | Chimp | [318-336] ORF |

TABLE B-continued additional 19 mers

| Number | Sense siRNA | AntiSense siRNA | Other Sp | Hum-34222182 ORF: 204-785 |
|---|---|---|---|---|
| 356 | AGGAGAACUCUGAUCCUCA | UGAGGAUCAGAGUUCUCCU | | [696-714] ORF |
| 357 | UUGCCAGAAUUUGGUUAAA | UUUAACCAAAUUCUGGCAA | Chimp | [362-380] ORF |
| 358 | UGUAUACUACCACUUUGAA | UUCAAAGUGGUAGUAUACA | | [1782-1800] 3'UTR |
| 359 | AUCCUGGUGUUACUGAAAA | UUUUCAGUAACACCAGGAU | | [2165-2183] 3'UTR |
| 360 | CAGCUAACAGGCUGAUUUU | AAAAUCAGCCUGUUAGCUG | | [938-956] 3'UTR |
| 361 | CCCAAAUGUAGUCuCUUUU | AAAAGAGACUACAUUUGGG | | [890-908] 3'UTR |
| 362 | CCAUGCAUGCACCCAGAUU | AAUCUGGGUGCAUGCAUGG | | [1893-1911] 3'UTR |
| 363 | AUGGUGAUGGCUUAUGGAA | UUCCAUAAGCCAUCACCAU | | [2497-2515] 3'UTR |
| 364 | GAACCAUUUCACCAUGGCA | UGCCAUGGUGAAAUGGUUC | | [1690-1708] 3'UTR |
| 365 | ACUAAACUUGGUUGCUCAA | UUGAGCAACCAAGUUUAGU | Chimp | [414-432] ORF |
| 366 | UUUUCUGCAUAGAUCCCAU | AUGGGAUCUAUGCAGAAAA | | [992-1010] 3'UTR |
| 367 | ACGAAGUCUGCAUUGGCUA | UAGCCAAUGCAGACUUCGU | | [1821-1839] 3'UTR |
| 368 | GAUCAUUAUCUCUUUCCUU | AAGGAAAGAGAUAAUGAUC | | [1962-2000] 3'UTR |
| 369 | UGGCUAUGGAGAUAUGGUU | AACCAUAUCUCCAUAGCCA | | [1834-1852] 3'UTR |
| 370 | GGUAGUAGCUGUAUAUACC | GUAGUAUACAGCUACUACC | | [1773-1791] 3'UTR |
| 371 | UUGGGCCAAGAUAAAUCAA | UUGAUUUAUCUUGGCCCAA | | [2310-2328] 3'UTR |
| 372 | CCAAUUGUCAAGGGUAGUA | UACUACCCUUGACAAUUGG | | [1761-1779] 3'UTR |
| 373 | CUUAGUAAUCUAUCCUCUU | AAGAGGAUAGAUUACUAAG | | [1642-1660] 3'UTR |
| 374 | UGGUGAUGGCUUAUGGAAG | CUUCCAUAAGCCAUCACCA | | [2496-2516] 3'UTR |
| 375 | CUGGAGUUGUCACCACUGA | UCAGUGGUGACAACUCCAG | | [2387-2405] 3'UTR |
| 376 | CACUGAUUGGAACAACAGU | ACUGUUGUUCCAAUCAGUG | | [751-769] ORF |
| 377 | CAGUUUGAGCAGCAAGAAC | GUUCUUGCUGCUCAAACUG | Chimp | [218-236] ORF |
| 378 | UAGGGACAGAUGUAUUCAU | AUGAAUACAUCUGUCCCUA | | [2148-2166] 3'UTR |
| 379 | CAAUCUUUAUAGAAUUGGG | CCCAAUUCUAUAAAGAUUG | | [2296-2314] 3'UTR |
| 380 | UGUCCUUUUCCACUAACA | UGUUAGUGGAAAAGGACA | | [2442-2460] 3'UTR |
| 381 | GUCCUAAAAGGGAAAAUA | UAUUUUCCCUUUUUAGGAC | | [779-797] ORF + 3'UTR |
| 382 | GGUUGCAACUGGCAGUUUG | CAAACUGCCAGUUGCAACC | Chimp | [206-224] ORF |
| 383 | AGCCUAUCAAAACUUCCAA | UUGGAAGUUUUGAUAGGCU | | [1217-1235] 3'UTR |
| 384 | CUAAACUCUUCAAAUGCUU | AAGCAUUUGAAGAGUUUAG | | [2259-2277] 3'UTR |
| 385 | CUUGGAUACCUGUCACUAG | CUAGUGACAGGUAUCCAAG | | [1920-1938] 3'UTR |
| 386 | CAACGAGGUAAUAUUUGAG | CUCAAAUAUUACCUCGUUG | Chimp | [335-353] ORF |
| 387 | GAGGUUGUGUUAUGCACGU | ACGUGCAUAACACAACCUC | | [514-532] ORF |
| 388 | CUUGCCAGAAUUUGGUUAA | UUAACCAAAUUCUGGCAAG | Chimp | [361-379] ORF |
| 389 | AAAAGCUUGUGGUGCCAUU | AAUGGCACCACAAGCUUUU | | [1420-1438] 3'UTR |
| 390 | GCAAGGCUUUCAUAUCCUU | AAGGAUAUGAAAGCCUUGC | | [2050-2068] 3'UTR |
| 391 | ACCUGUCACUAGGGAAUAA | UUAUUCCCUAGUGACAGGU | | [1927-1945] 3'UTR |
| 392 | AGCUUGUGGUGCCAUUUCA | UGAAAUGGCACCACAAGCU | | [1423-1441] 3'UTR |

TABLE B-continued additional 19 mers

| Number | Sense siRNA | AntiSense siRNA | Other Sp | Hum-34222182 ORF: 204-785 |
|---|---|---|---|---|
| 393 | GGGACUUUUCUUUAGUAG | CUACUAAAGAAAAAGUCCC | | [665-673] ORF |
| 394 | CUAGGUAAGAGUAAAUGAG | CUCAUUUACUCUUACCUAG | | [1326-1344] 3'UTR |
| 395 | CGUACCUACUUUUGAGCUU | AAGCUCAAAAGUAGGUACG | | [593-611] ORF |
| 396 | AAGAUACUACAAAGCCAAU | AUUGGCUUUGUAGUAUCUU | | [2281-2299] 3'UTR |
| 397 | CUCAGGAUUUCGACUUGUU | AACAAGUCGAAAUCCUGAG | | [716-734] ORF |
| 398 | CUUUAUAGAAUUGGGCCAA | UUGGCCCAAUUCUAUAAAG | | [2300-2318] 3'UTR |
| 399 | CCCAUUUUUGUACAGAAUU | AAUUCUGUACAAAAAUGGG | | [1006-1024] 3'UTR |
| 400 | UUGUGGUGCCAUUUCAGUA | UACUGAAAUGGCACCACAA | | [1426-1444] 3'UTR |
| 401 | GUGUGUAGUUGAUUACUCU | AGAGUAAUCAACUACACAC | | [1552-1570] 3'UTR |
| 402 | GUUUAUAGUACAGCCUAGA | UCUAGGCUGUACUAUAAAC | | [1850-1868] 3'UTR |
| 403 | AUGAGAAAUAUUACGGCAA | UUGCCGUAAUAUUUCUCAU | | [1340-1358] 3'UTR |
| 404 | CACCCAGAUUUUUUCCACC | GGUGGAAAAAUCUGGGUG | | [1902-1920] 3'UTR |
| 405 | AUCCCAUUUUUGUACAGAA | UUCUGUACAAAAAUGGGAU | | [1004-1022] 3'UTR |
| 406 | CAGAAUUGCUGGACUGUGG | CCACAGUCCAGCAAUUCUG | Chimp | [250-258] ORF |
| 407 | UGACUACUGGGAUUAUGUU | AACAUAAUCCCAGUAGUCA | Chimp | [299-317] ORF |
| 408 | GAUCCUGUUACUGAUACUA | UAGUAUCAGUAACAGGAUC | | [2192-2210] 3'UTR |
| 409 | UCCAAAUCAAAGCAAACUA | UAGUUUGCUUUGAUUUGGA | Chimp | [399-417] ORF |
| 410 | UCUGGGCUUUUCUGGGAAU | AUUCCCAGAAAAGCCCAGA | | [1722-1740] 3'UTR |
| 411 | CCAUUUUUGUACAGAAUUG | CAAUUCUGUACAAAAAUGG | | [1007-1025] 3'UTR |
| 412 | CUGGCCUUUGGAGAAGUGA | UCACUUCUCCAAAGGCCAG | | [957-975] 3'UTR |
| 413 | UAGGAAAUUAGUUCUGAGA | UCUCAGAACUAAUUUCCUA | | [1603-1621] 3'UTR |
| 414 | CUUAAUCUCAGAUGAACCA | UGGUUCAUCUGAGAUUAAG | | [1677-1695] 3'UTR |
| 415 | AGGAAAUUAGUUCUGAGAU | AUCUCAGAACUAAUUUCCU | | [1604-1622] 3'UTR |
| 416 | AGGCUUGGUAAUAGACUAU | AUAGUCUAUUACCAAGCCU | | [1101-1119] 3'UTR |
| 417 | GAAUUUGGUUAAAAUGCUG | CAGCAUUUUAACCAAAUUC | Chimp | [368-388] ORF |
| 418 | UAGACAGGAAGGUAGGAUU | AAUCCUACCUUCCUGUCUA | | [1278-1296] 3'UTR |
| 419 | UUGAAGUAUCUCUCCUUAA | UUAAGGAGAGAUACUUCAA | | [1740-1758] 3'UTR |
| 420 | CUUUGACUCUCUUGCCUGU | ACAGGCAAGAGAGUCAAAG | | [2466-2484] 3'UTR |
| 421 | UGUGGCUAUCACCCAGAGA | UCUCUGGGUGAUAGCCACA | Chimp | [264-282] ORF |
| 422 | AGGCCUUAUUUUUGUCUU | AAGACAAAAAUAAGGCCU | | [1949-1967] 3'UTR |
| 423 | CAGUGUUAUCUCAUCUCUG | CAGAGAUGAGAUAACACUG | | [1707-1725] 3'UTR |
| 424 | UGAGAAACUGACCCAGAGA | UCUCUGGGUCAGUUUCUCA | Chin, GP, Chimp, Rat, Ms | [446-464] ORF |
| 425 | UGUUGUUCCUGAACCCAAC | GUUGGGUUCAGGAACAACA | Chimp | [314-332] ORF |
| 426 | GUUGUCCUUUUUCCACUAA | UUAGUGGAAAAAGGACAAC | | [2440-2458] 3'UTR |
| 427 | GGCAAUAAUGGAACUGCUU | AAGCAGUUCCAUUAUUGCC | | [1354-1372] 3'UTR |
| 428 | ACAAUGUUCAAUUCAGCAA | UUGCUGAAUUGAACAUUGU | | [2035-2053] 3'UTR |

TABLE B-continued additional 19 mers

| Number | Sense siRNA | AntiSense siRNA | Other Sp | Hum-34222182 ORF: 204-785 |
|---|---|---|---|---|
| 429 | GCAACUGGCAGUUUGAGCA | UGCUCAAACUGCCAGUUGC | Dog, Chimp | [210-228] ORF |
| 430 | GGGUUUUUAGACAGGAAGG | CCUUCCUGUCUAAAAACCC | | [1271-1289] 3'UTR |
| 431 | GUAGGAUUAAGUAGGUGAG | CUCACCUACUUAAUCCUAC | | [1289-1307] 3'UTR |
| 432 | UGAAACUCACCGUCCAGAU | AUCUGGACGGUGAGUUUCA | | [1872-1890] 3'UTR |
| 433 | UGAUCCUGUUACUGAUACU | AGUAUCAGUAACAGGAUCA | | [2191-2209] 3'UTR |
| 434 | AUUUCAUGAUUGGGUAGUA | UACUACCCAAUCAUGAAAU | | [808-826] 3'UTR |
| 435 | AGAUGCCUUUAUAAGCUCA | UGAGCUUAUAAAGGCAUCU | | [1461-1479] 3'UTR |
| 436 | CCUCAACGAGGUAAUAUUU | AAAUAUUACCUCGUUGAGG | Chimp | [332-350] ORF |
| 437 | GUUAAGCUCCAAAGGUUCA | UGAACCUUUGGAGCUUAAC | | [2349-2367] 3'UTR |
| 438 | CCUAGCUAUUAGCUCCACU | AGUGGAGCUAAUAGCUAGG | | [2109-2127] 3'UTR |
| 439 | GUAGGGACAGAUGUAUUCA | UGAAUACAUCUGUCCCUAC | | [2147-2165] 3'UTR |
| 440 | UUCUGUGUUUCACAUUCAU | AUGAAUGUGAAACACAGAA | | [911-929] 3'UTR |
| 441 | GGUAGGCUUGGUAAUAGAC | GUCUAUUACCAAGCCUACC | | [1098-1116] 3'UTR |
| 442 | CAGGUGUGAUCCUGUUACU | AGUAACAGGAUCACACCUG | | [2185-2203] 3'UTR |
| 443 | UAUUCAGCUAGUCAGCUAA | UUAGCUGACUAGCUGAAUA | | [831-849] 3'UTR |
| 444 | ACUCUUCAAAUGCUUGGAA | UUCCAAGCAUUUGAAGAGU | | [2263-2281] 3'UTR |
| 445 | UGGACUAGCUUCAGGGACU | AGUCCCUGAAGCUAGUCCA | Chimp | [642-680] ORF |
| 446 | UGCACGUGAACUUGGAAAU | AUUUCCAAGUUCACGUGCA | Dog, Chin, GP, Rat | [526-544] ORF |
| 447 | CAUCGAUGUAGAACUGUUG | CAACAGUUCUACAUCGAUG | | [2425-2443] 3'UTR |
| 448 | GAGCUUACACUUGUGUUUA | UAAACACAAGUGUAAGCUC | Chimp | [606-624] ORF |
| 449 | UGUUUCACAUUCAUAGCAA | UUGCUAUGAAUGUGAAACA | | [916-934] 3'UTR |
| 450 | CCUCACUCUAAUGUUUUAA | UUAAAACAUUAGAGUGAGG | | [1392-1410] 3'UTR |
| 451 | GGCUGAUUUUCUGGCCUUU | AAAGGCCAGAAAAUCAGCC | | [947-965] 3'UTR |
| 452 | UCUGGGAAUUGAAGUAUCU | AGAUACUUCAAUUCCCAGA | | [1732-1750] 3'UTR |
| 453 | CUUUUGAGCUUACACUUGU | ACAAGUGUAAGCUCAAAAG | Chimp | [601-619] ORF |
| 454 | CACUGUUUCUUGGUGACUU | AAGUCACCAAGAAACAGUG | | [1373-1391] 3'UTR |
| 455 | UGUUCAAAUUAGCCAGUGU | ACACUGGCUAAUUUGAACA | | [2231-2249] 3'UTR |
| 456 | AAUGAGAAAUAUUACGGCA | UGCCGUAAUAUUUCUCAUU | | [1339-1357] 3'UTR |
| 457 | CAUGGCAGUGUUAUCUCAU | AUGAGAUAACACUGCCAUG | | [1702-1720] 3'UTR |
| 458 | CUGUUAUGCUUACAAAAUG | CAUUUUGUAAGCAUAACAG | | [2481-2499] 3'UTR |
| 459 | GCUUUCAUAUCCUUGCUGU | ACAGCAAGGAUAUGAAAGC | | [2055-2073] 3'UTR |
| 460 | AGCUAAAGUCAUUUGUAGU | ACUACAAAUGACUUUAGCU | | [844-862] 3'UTR |
| 461 | UCUGUGUUUCACAUUCAUA | UAUGAAUGUGAAACACAGA | | [912-930] 3'UTR |
| 462 | AUUAGCCAGUGUUCUAACA | UGUUAGAACACUGGCUAAU | | [2238-2256] 3'UTR |
| 463 | AGUAGAAGCCCAUUUGAGU | ACUCAAAUGGGCUUCUACU | | [1050-1068] 3'UTR |
| 464 | AUGUAUUCAUCCUGGUGUU | AACACCAGGAUGAAUACAU | | [2157-2175] 3'UTR |
| 465 | GUAGUUGAUUACUCUUCCA | UGGAAGAGUAAUCAACUAC | | [1556-1574] 3'UTR |

TABLE B-continued additional 19 mers

| Number | Sense siRNA | AntiSense siRNA | Other Sp | Hum-34222182 ORF: 204-785 |
|---|---|---|---|---|
| 466 | UGUAAAAAGCUGGAUAGGA | UCCUAUCCAGCUUUUUACA | Chin, GP, Chimp, Rat, Ms | [555-573] ORF |
| 467 | UGUUUUGCAUGUCUAUUGU | ACAAUAGACAUGCAAAACA | | [2332-2350] 3'UTR |
| 468 | CUUCAAAUGCUUGGAAAGA | UCUUUCCAAGCAUUUGAAG | | [2266-2284] 3'UTR |
| 469 | UCAUAGCAACUGCAGCUAA | UUAGCUGCAGUUGCUAUGA | | [926-944] 3'UTR |
| 470 | CAGCCUAGAGAAUGAAACU | AGUUUCAUUCUCUAGGCUG | | [1860-1878] 3'UTR |
| 471 | UAUUACGGCAAUAAUGGAA | UUCCAUUAUUGCCGUAAUA | | [1348-1366] 3'UTR |
| 472 | AAAGGUUCACUGUGUUUCU | AGAAACACAGUGAACCUUU | | [2359-2377] 3'UTR |
| 473 | GUGAUUUUGACUACUGGGA | UCCCAGUAGUCAAAAUCAC | Chimp | [292-310] ORF |
| 474 | AAGCAAAAGUAGAAGCCCA | UGGGCUUCUACUUUUGCUU | | [1043-1061] 3'UTR |
| 475 | GGUUUCCUGCCCUAGCUAU | AUAGCUAGGGCAGGAAACC | | [2099-2117] 3'UTR |
| 476 | CUCUUUUCUUUCUGUGUUU | AAACACAGAAAGAAAAGAG | | [902-920] 3'UTR |
| 477 | GCCCUAGCUAUUAGCUCCA | UGGAGCUAAUAGCUAGGGC | | [2107-2125] 3'UTR |
| 478 | CCAGCAUUUCAGAAUUGCU | AGCAAUUCUGAAAUGCUGG | Chimp | [241-259] ORF |
| 479 | AGGGACUUUUUCUUUAGUA | UACUAAAGAAAAAGUCCCU | | [654-672] ORF |
| 480 | CAAAUGUAGUCUCUUUUCU | AGAAAAGAGACUACAUUUG | | [892-910] 3'UTR |
| 481 | CCAAGAUAAAUCAAUGUUG | CAACAUUGAUUUAUCUUGG | | [2315-2333] 3'UTR |
| 482 | AUGUAUGUAAAAGCUGGA | UCCAGCUUUUUACAUACAU | Chimp, Ms | [550-568] ORF |
| 483 | CGGUGUUGUUUUAGAUGCC | GGCAUCUAAAACAACACCG | | [1449-1467] 3'UTR |
| 484 | CAGAUUUUUUCCACCUUGG | CCAAGGUGGAAAAAAUCUG | | [1906-1924] 3'UTR |
| 485 | CAAAAGUAGAAGCCCAUUU | AAAUGGGCUUCUACUUUUG | | [1048-1064] 3'UTR |
| 486 | UUAUAGAAUUGGGCCAAGA | UCUUGGCCCAAUUCUAUAA | | [2302-2320] 3'UTR |
| 487 | AAGGUAGGAUUAAGUAGGU | ACCUACUUAAUCCUACCUU | | [1296-1304] 3'UTR |
| 488 | UAAGGAGCUUAUUCAGGUU | AACCUGAAUAAGCUCCUUA | | [2084-2102] 3'UTR |
| 489 | GUGUUGUUUUAGAUGCCUU | AAGGCAUCUAAAACAACAC | | [1451-1469] 3'UTR |
| 490 | GUUUCCUGCCCUAGCUAUU | AAUAGCUAGGGCAGGAAAC | | [2100-2118] 3'UTR |
| 491 | AUUCAGCAAGGCUUUCAUA | UAUGAAAGCCUUGCUGAAU | | [2945-2063] 3'UTR |
| 492 | CAAUUGGUUUCAGGUAGG | CCUACCUGAAACCAAUUG | | [1085-1103] 3'UTR |
| 493 | GUUGUUUUAGAUGCCUUUA | UAAAGGCAUCUAAAACAAC | | [1453-1471] 3'UTR |
| 494 | GCAUUGGCUAUGGAGAUAU | AUAUCUCCAUAGCCAAUGC | | [1830-1848] 3'UTR |
| 495 | CUGAGAAACUGACCCAGAG | CUCUGGGUCAGUUUCUCAG | Dog, Chin, GP, Chimp, Rat, Ms | [445-463] ORF |
| 496 | UAUGCUUACAAAAUGGUGA | UCACCAUUUUGUAAGCAUA | | [2485-2503] 3'UTR |
| 497 | AACUAAACUUGGUUGCUCA | UGAGCAACCAAGUUUAGUU | Chimp | [413-431] ORF |
| 498 | AAUGCUUGGAAAGAUACUA | UAGUAUCUUUCCAAGCAUU | | [2271-2289] 3'UTR |
| 499 | GUCUGUCCAAAUCAAAGCA | UGCUUUGAUUUGGACAGAC | Dog, Chimp | [394-412] ORF |
| 500 | AUUGCUGGACUGUGGCUAU | AUAGCCACAGUCCAGCAAU | Chimp | [254-272] ORF |

TABLE C

21 mers

| Number | Sense siRNA | AntiSense siRNA | Other Sp | Hum-34222182 ORF: 204-785 |
|---|---|---|---|---|
| 1 | GCCAGUGUUCUAACAAACUAA | UUAGUUUGUUAGAACACUGGC | | [2242-2262](21/21) 3'UTR |
| 2 | GGAUGGAAUAGGUAAGCAAAA | UUUUGCUUACCUAUUCCAUCC | | [1030-1050](21/21) 3'UTR |
| 3 | GGAUUAAGUAGGUGAGUUUAA | UUAAACUCACCUACUUAAUCC | | [1292-1312](21/21) 3'UTR |
| 4 | CCACCUGCCCUAAAUAAGAAA | UUUCUUAUUUAGGGCAGGUGG | | [868-888](21/21) 3'UTR |
| 5 | CAGUGUUCUAACAAACUAAAC | GUUUAGUUUGUUAGAACACUG | | [2244-2264](21/21) 3'UTR |
| 6 | CAGUGAUUGAAGGGUCCUAAA | UUUAGGACCCUUCAAUCACUG | | [766-786](21/21) ORF + 3'UTR |
| 7 | GCUGGAGAACUGUCUGUCCAA | UUGGACAGACAGUUCUCCAGC | Dog, Chimp | [383-403](21/21) ORF |
| 8 | GAGUGAAUGAUGAAUACCUGU | ACAGGUAUUCAUCAUUCACUC | | [1577-1597](21/21) 3'UTR |
| 9 | GGAUUUCGACUUGUUAAGAAA | UUUCUUAACAAGUCGAAAUCC | Rat | [720-740](21/21) ORF |
| 10 | GGAAAUUAGUUCUGAGAUCUA | UAGAUCUCAGAACUAAUUUCC | | [1605-1625](21/21) 3'UTR |
| 11 | ACGUGAACUUGGAAAUUGAAA | UUUCAAUUUCCAAGUUCACGU | Dog, Chin, GP, Rat | [529-549](21/21) ORF |
| 12 | UAGCCAGUGUUCUAACAAACU | AGUUUGUUAGAACACUGGCUA | | [2240-2260](21/21) 3'UTR |
| 13 | CAUCCUGGUGUUACUGAAAAA | UUUUUCAGUAACACCAGGAUG | | [2164-2184](21/21) 3'UTR |
| 14 | AGCCAGUGUUCUAACAAACUA | UAGUUUGUUAGAACACUGGCU | | [2241-2261](21/21) 3'UTR |
| 15 | CGUGAACUUGGAAAUUGAAAA | UUUUCAAUUUCCAAGUUCACG | Dog, Chin, GP, Rat | [530-550](21/21) ORF |
| 16 | UGGGCUUUUCUGGGAAUUGAA | UUCAAUUCCCAGAAAAGCCCA | | [1724-1744](21/21) 3'UTR |
| 17 | GGAAAGAUACUACAAAGCCAA | UUGGCUUUGUAGUAUCUUUCC | | [2278-2298](21/21) 3'UTR |
| 18 | CACGUGAACUUGGAAAUUGAA | UUCAAUUUCCAAGUUCACGUG | Dog, Chin, GP, Rat | [528-548](21/21) ORF |
| 19 | GCACGUGAACUUGGAAAUUGA | UCAAUUUCCAAGUUCACGUGC | Dog, Chin, GP, Rat | [527-547](21/21) ORF |
| 20 | GGCUUAUGGAAGGCUGUUAAA | UUUAACAGCCUUCCAUAAGCC | | [2505-2525](21/21) 3'UTR |
| 21 | GGAGAUAUGGUUUAUAGUACA | UGUACUAUAAACCAUAUCUCC | | [1841-1861](21/21) 3'UTR |
| 22 | GGGAUGGAAUAGGUAAGCAAA | UUUGCUUACCUAUUCCAUCCC | | [1029-1049](21/21) 3'UTR |
| 23 | CAAUGUUGUUUUGCAUGUCUA | UAGACAUGCAAAACAACAUUG | | [2326-2346](21/21) 3'UTR |
| 24 | AGUACAGCCUAGAGAAUGAAA | UUUCAUUCUCUAGGCUGUACU | | [1856-1876](21/21) 3'UTR |
| 25 | CUUUGGAGAAGUGAUUCAAAA | UUUUGAAUCACUUCUCCAAAG | | [962-982](21/21) 3'UTR |
| 26 | CCUUUGGAGAAGUGAUUCAAA | UUUGAAUCACUUCUCCAAAGG | | [961-981](21/21) 3'UTR |
| 27 | CAGAAUUGAAUGGGAUGGAAU | AUUCCAUCCCAUUCAAUUCUG | | [1018-1038](21/21) 3'UTR |
| 28 | UGGGAUGGAAUAGGUAAGCAA | UUGCUUACCUAUUCCAUCCCA | | [1028-1048](21/21) 3'UTR |
| 29 | CCAGAUUUUUCCACCUUGGA | UCCAAGGUGGAAAAAUCUGG | | [1905-1925](21/21) 3'UTR |
| 30 | GAAGGGUCCUAAAAAGGGAAA | UUUCCCUUUUUAGGACCCUUC | | [774-794](21/21) ORF + 3'UTR |
| 31 | CUUCCUCACUCUAAUGUUUUA | UAAAACAUUAGAGUGAGGAAG | | [1389-1409](21/21) 3'UTR |
| 32 | GAACUGUCUGUCCAAAUCAAA | UUUGAUUUGGACAGACAGUUC | Dog, Chimp | [389-409](21/21) ORF |
| 33 | CAACAAUGUUCAAUUCAGCAA | UUGCUGAAUUGAACAUUGUUG | | [2033-2053](21/21) 3'UTR |
| 34 | CUAGGUAAGAGUAAAUGAGAA | UUCUCAUUUACUCUUACCUAG | | [1326-1346](21/21) 3'UTR |
| 35 | AGUGAUUGAAGGGUCCUAAAA | UUUUAGGACCCUUCAAUCACU | | [767-787](21/21) ORF + 3'UTR |
| 36 | GUGAUUGAAGGGUCCUAAAAA | UUUUUAGGACCCUUCAAUCAC | | [768-788](21/21) ORF + 3'UTR |
| 37 | GAAUGAUGAAUACCUGUGAGG | CCUCACAGGUAUUCAUCAUUC | | [1581-1601](21/21) 3'UTR |
| 38 | CCUCUCUGAUUCACUUAGUAA | UUACUAAGUGAAUCAGAGAGG | | [1629-1649](21/21) 3'UTR |

TABLE C-continued 21 mers

| Number | Sense siRNA | AntiSense siRNA | Other Sp | Hum-34222182 ORF: 204-785 |
|---|---|---|---|---|
| 39 | AGAUUUUUCCACCUUGGAUA | UAUCCAAGGUGGAAAAAAUCU | | [1907-1927](21/21) 3'UTR |
| 40 | GAAUUUAGCCUCCACUCAACA | UGUUGAGUGGAGGCUAAAUUC | | [2017-2037](21/21) 3'UTR |
| 41 | GAAUAGGUAAGCAAAAGUAGA | UCUACUUUUGCUUACCUAUUC | | [1035-1055](21/21) 3'UTR |
| 42 | GGUCGUGGAUAAGGAGCUUAU | AUAAGCUCCUUAUCCACGACC | | [2075-2095](21/21) 3'UTR |
| 43 | GGCUUGGUAAUAGACUAUAUA | UAUAUAGUCUAUUACCAAGCC | | [1102-1122](21/21) 3'UTR |
| 44 | CUGUCACUAGGGAAUAAUAAA | UUUAUUAUUCCCUAGUGACAG | | [1929-1949](21/21) 3'UTR |
| 45 | CUUGGUGACUUCCUCACUCUA | UAGAGUGAGGAAGUCACCAAG | | [1381-1401](21/21) 3'UTR |
| 46 | CCUAGGUAAGAGUAAAUGAGA | UCUCAUUUACUCUUACCUAGG | | [1325-1345](21/21) 3'UTR |
| 47 | GCUUGUGGUGCCAUUUCAGUA | UACUGAAAUGGCACCACAAGC | | [1424-1444](21/21) 3'UTR |
| 48 | GAUGAAUACCUGUGAGGAUAG | CUAUCCUCACAGGUAUUCAUC | | [1585-1605](21/21) 3'UTR |
| 49 | GGUGUGAUCCUGUUACUGAUA | UAUCAGUAACAGGAUCACACC | | [2187-2207](21/21) 3'UTR |
| 50 | GGGUCGUGGAUAAGGAGCUUA | UAAGCUCCUUAUCCACGACCC | | [2074-2094](21/21) 3'UTR |
| 51 | ACCUAAAAUGUCACUGUUCAA | UUGAACAGUGACAUUUUAGGU | | [2217-2237](21/21) 3'UTR |
| 52 | GAUCCUGUUACUGAUACUAUA | UAUAGUAUCAGUAACAGGAUC | | [2192-2212](21/21) 3'UTR |
| 53 | CAAAGGUCCUUGUCCCUGAGA | UCUCAGGGACAAGGACCUUUG | Chimp | [430-450](21/21) ORF |
| 54 | AAAUGGUGAUGGCUUAUGGAA | UUCCAUAAGCCAUCACCAUUU | | [2495-2515](21/21) 3'UTR |
| 55 | CGUAGGGACAGAUGUAUUCAU | AUGAAUACAUCUGUCCCUACG | | [2146-2166](21/21) 3'UTR |
| 56 | AUAGAAUUGGGCCAAGAUAAA | UUUAUCUUGGCCCAAUUCUAU | | [2304-2324](21/21) 3'UTR |
| 57 | GAAAGAUACUACAAAGCCAAU | AUUGGCUUUGUAGUAUCUUUC | | [2279-2299](21/21) 3'UTR |
| 58 | GCUUCAGGGACUUUUUCUUUA | UAAAGAAAAGUCCCUGAAGC | Chimp | [649-669](21/21) ORF |
| 59 | CAUGAUUGGGUAGUAAAACUA | UAGUUUUACUACCCAAUCAUG | | [812-832](21/21) 3'UTR |
| 60 | AAUUAGCCAGUGUUCUAACAA | UUGUUAGAACACUGGCUAAUU | | [2237-2257](21/21) 3'UTR |
| 61 | UCAGGUAGGCUUGGUAAUAGA | UCUAUUACCAAGCCUACCUGA | | [1095-1115](21/21) 3'UTR |
| 62 | UGAAUGGGAUGGAAUAGGUAA | UUACCUAUUCCAUCCCAUUCA | | [1024-1044](21/21) 3'UTR |
| 63 | CGGUGUUGUUUUAGAUGCCUU | AAGGCAUCUAAAACAACACCG | | [1449-1469](21/21) 3'UTR |
| 64 | GGUUUCAGGUAGGCUUGGUAA | UUACCAAGCCUACCUGAAACC | | [1091-1111](21/21) 3'UTR |
| 65 | GCUGAUUUUCUGGCCUUUGGA | UCCAAAGGCCAGAAAAUCAGC | | [948-968](21/21) 3'UTR |
| 66 | CCUCCACUCAACAAUGUUCAA | UUGAACAUUGUUGAGUGGAGG | | [2025-2045](21/21) 3'UTR |
| 67 | GCUGUAUACUACCACUUUGAA | UUCAAAGUGGUAGUAUACAGC | | [1780-1800](21/21) 3'UTR |
| 68 | CGAAGGAAACAGAGCCGUUGA | UCAACGGCUCUGUUUCCUUCG | Chimp | [181-201](21/21) 5'UTR |
| 69 | UGAGCUUACACUUGUGUUUAA | UUAAACACAAGUGUAAGCUCA | Chimp | [605-625](21/21) ORF |
| 70 | CGGCGUAGGGACAGAUGUAUU | AAUACAUCUGUCCCUACGCCG | | [2143-2163](21/21) 3'UTR |
| 71 | AGAAUUGAAUGGGAUGGAAUA | UAUUCCAUCCCAUUCAAUUCU | | [1019-1039](21/21) 3'UTR |
| 72 | CAGAGAGCCUGCUAAGUGAUU | AAUCACUUAGCAGGCUCUCUG | Chimp | [277-297](21/21) ORF |
| 73 | UAUAGAAUUGGGCCAAGAUAA | UUAUCUUGGCCCAAUUCUAUA | | [2303-2323](21/21) 3'UTR |
| 74 | CUCAGGAUUUCGACUUGUUAA | UUAACAAGUCGAAAUCCUGAG | | [716-736](21/21) ORF |
| 75 | CUUCAAAUGCUUGGAAAGAUA | UAUCUUUCCAAGCAUUUGAAG | | [2266-2286](21/21) 3'UTR |
| 76 | GGUCCUAAAAAGGGAAAAUAU | AUAUUUUCCCUUUUUAGGACC | | [778-796](21/21) ORF + 3'UTR |

TABLE C-continued 21 mers

| Number | Sense siRNA | AntiSense siRNA | Other Sp | Hum-34222182 ORF: 204-785 |
|---|---|---|---|---|
| 77 | UGGAGAACUGUCUGUCCAAAU | AUUUGGACAGACAGUUCUCCA | Dog, Chimp | [385-405](21/21) ORF |
| 78 | GCUCAGGAUUUCGACUUGUUA | UAACAAGUCGAAAUCCUGAGC | | [715-735](21/21) ORF |
| 79 | GAGCCUGCUAAGUGAUUUGA | UCAAAAUCACUUAGCAGGCUC | Chimp | [281-301](21/21) ORF |
| 80 | UGAUGAAUACCUGUGAGGAUA | UAUCCUCACAGGUAUUCAUCA | | [1584-1604](21/21) 3'UTR |
| 81 | GAGAAUUUAGCCUCCACUCAA | UUGAGUGGAGGCUAAAUUCUC | | [2015-2035](21/21) 3'UTR |
| 82 | GGCCUUUGGAGAAGUGAUUCA | UGAAUCACUUCUCCAAAGGCC | | [959-979](21/21) 3'UTR |
| 83 | UGAAGGGUUUUUAGACAGGAA | UUCCUGUCUAAAAACCCUUCA | | [1267-1287](21/21) 3'UTR |
| 84 | GAGGAAUCAACUUGCCAGAAU | AUUCUGGCAAGUUGAUUCCUC | Chimp | [351-371](21/21) ORF |
| 85 | AGGAUUUCGACUUGUUAAGAA | UUCUUAACAAGUCGAAAUCCU | | [719-739](21/21) ORF |
| 86 | AGUUCCUGACUCAAAUUUGAA | UUCAAAUUUGAGUCAGGAACU | | [1250-1270](21/21) 3'UTR |
| 87 | ACAGGAAGGUAGGAUUAAGUA | UACUUAAUCCUACCUUCCUGU | | [1281-1301](21/21) 3'UTR |
| 88 | CUUGCUGUGGGUCGUGGAUAA | UUAUCCACGACCCACAGCAAG | | [2066-2086](21/21) 3'UTR |
| 89 | GCUGGAUAGGAUUGUGUGUGA | UCACACACAAUCCUAUCCAGC | Chin, GP, Chimp, Rat | [563-583](21/21) ORF |
| 90 | UUAUGUUGUUCCUGAACCCAA | UUGGGUUCAGGAACAACAUAA | Chimp | [311-331](21/21) ORF |
| 91 | CCUAAAAUGUCACUGUUCAAA | UUUGAACAGUGACAUUUUAGG | | [2218-2238](21/21) 3'UTR |
| 92 | GAUAGGAAAUUAGUUCUGAGA | UCUCAGAACUAAUUUCCUAUC | | [1601-1621](21/21) 3'UTR |
| 93 | GUUUCAGGUAGGCUUGGUAAU | AUUACCAAGCCUACCUGAAAC | | [1092-1112](21/21) 3'UTR |
| 94 | GAUUUUCUGGCCUUUGGAGAA | UUCUCCAAAGGCCAGAAAAUC | | [951-971](21/21) 3'UTR |
| 95 | CUGUGAGGAUAGGAAAUUAGU | ACUAAUUUCCUAUCCUCACAG | | [1594-1614](21/21) 3'UTR |
| 96 | GGUAGGCUUGGUAAUAGACUA | UAGUCUAUUACCAAGCCUACC | | [1098-1118](21/21) 3'UTR |
| 97 | GAAUGAAACUCACCGUCCAGA | UCUGGACGGUGAGUUUCAUUC | | [1869-1889](21/21) 3'UTR |
| 98 | CGUGGAUAAGGAGCUUAUUCA | UGAAUAAGCUCCUUAUCCACG | | [2078-2098](21/21) 3'UTR |
| 99 | GUGAAUGAUGAAUACCUGUGA | UCACAGGUAUUCAUCAUUCAC | | [1579-1599](21/21) 3'UTR |
| 100 | AAUUUAGCCUCCACUCAACAA | UUGUUGAGUGGAGGCUAAAUU | | [2018-2038](21/21) 3'UTR |
| 101 | GGAGAAGUGAUUCAAAAUAGU | ACUAUUUUGAAUCACUUCUCC | | [966-986](21/21) 3'UTR |
| 102 | CCACCAGUUCCUGACUCAAAU | AUUUGAGUCAGGAACUGGUGG | | [1245-1265](21/21) 3'UTR |
| 103 | UAGACAGGAAGGUAGGAUUAA | UUAAUCCUACCUUCCUGUCUA | | [1278-1298](21/21) 3'UTR |
| 104 | UGGGAUUAUGUUGUUCCUGAA | UUCAGGAACAACAUAAUCCCA | Chimp | [306-326](21/21) ORF |
| 105 | AAUGGGCCAAGAUAAAUCAA | UUGAUUUAUCUUGGCCCAAUU | | [2308-2328](21/21) 3'UTR |
| 106 | GGAUAAGGAGCUUAUUCAGGU | ACCUGAAUAAGCUCCUUAUCC | | [2081-2101](21/21) 3'UTR |
| 107 | AUUAGCCAGUGUUCUAACAAA | UUUGUUAGAACACUGGCUAAU | | [2238-2258](21/21) 3'UTR |
| 108 | UGGCUAUGGAGAUAUGGUUUA | UAAACCAUAUCUCCAUAGCCA | | [1834-1854](21/21) 3'UTR |
| 109 | GUCCAAAUCAAAGCAAACUAA | UUAGUUUGCUUUGAUUUGGAC | Chimp | [398-418](21/21) ORF |
| 110 | UGGAUACCUGUCACUAGGGAA | UUCCCUAGUGACAGGUAUCCA | | [1922-1942](21/21) 3'UTR |
| 111 | CCACCUUGGAUACCUGUCACU | AGUGACAGGUAUCCAAGGUGG | | [1916-1936](21/21) 3'UTR |
| 112 | AUGUGCUUAAUCUCAGAUGAA | UUCAUCUGAGAUUAAGCACAU | | [1672-1692](21/21) 3'UTR |
| 113 | CCAUUGAGUGAAUGAUGAAUA | UAUUCAUCAUUCACUCAAUGG | | [1572-1592](21/21) 3'UTR |
| 114 | CCUUUUUCCACUAACAGUUAU | AUAACUGUUAGUGGAAAAAGG | | [2445-2465](21/21) 3'UTR |

TABLE C-continued 21 mers

| Number | Sense siRNA | AntiSense siRNA | Other Sp | Hum-34222182 ORF: 204-785 |
|---|---|---|---|---|
| 115 | GGUCAAUUUACGAAGUCUGCA | UGCAGACUUCGUAAAUUGACC | | [1812-1832](21/21) 3'UTR |
| 116 | CCCUCUCUGAUUCACUUAGUA | UACUAAGUGAAUCAGAGAGGG | | [1628-1648](21/21) 3'UTR |
| 117 | CUGUUGUCCUUUUUCCACUAA | UUAGUGGAAAAAGGACAACAG | | [2438-2458](21/21) 3'UTR |
| 118 | UGCUUGGAAAGAUACUACAAA | UUUGUAGUAUCUUUCCAAGCA | | [2273-2293](21/21) 3'UTR |
| 119 | CAAUUCAGCAAGGCUUUCAUA | UAUGAAAGCCUUGCUGAAUUG | | [2043-2063](21/21) 3'UTR |
| 120 | GUGUGUGAUUCUAGCGUCGUA | UACGACGCUAGAAUCACACAC | | [576-596](21/21) ORF |
| 121 | CCUGCUAAGUGAUUUGACUA | UAGUCAAAAUCACUUAGCAGG | Chimp | [284-304](21/21) ORF |
| 122 | CUCUCUUGCCUGUUAUGCUUA | UAAGCAUAACAGGCAAGAGAG | | [2472-2492](21/21) 3'UTR |
| 123 | GUUAUGCACGUGAACUUGGAA | UUCCAAGUUCACGUGCAUAAC | Dog, Chin, GP, Rat | [522-542](21/21) ORF |
| 124 | CAAAGUAGAAGCCCAUUUGA | UCAAAUGGGCUUCUACUUUUG | | [1046-1066](21/21) 3'UTR |
| 125 | GCUAUUAGCUCCACUUCACAU | AUGUGAAGUGGAGCUAAUAGC | | [2113-2133](21/21) 3'UTR |
| 126 | AGUUGAUUACUCUUCCAAUUGA | UCAAUGGAAGAGUAAUCAACU | | [1558-1578](21/21) 3'UTR |
| 127 | GAAUUUGGUUAAAAUGCUGGA | UCCAGCAUUUUAACCAAAUUC | Chimp | [368-388](21/21) ORF |
| 128 | GGGCUUUUCUGGGAAUUGAAG | CUUCAAUUCCCAGAAAAGCCC | | [1725-1745](21/21) 3'UTR |
| 129 | UUGCCUGUUAUGCUUACAAAA | UUUUGUAAGCAUAACAGGCAA | | [2477-2497](21/21) 3'UTR |
| 130 | GAGGUUGUGUUAUGCACGUGA | UCACGUGCAUAACACAACCUC | | [514-534](21/21) ORF |
| 131 | GAAGCCCAUUUGAGUUUUACA | UGUAAAACUCAAAUGGGCUUC | | [1054-1074](21/21) 3'UTR |
| 132 | GGCUUUUCUGGGAAUUGAAGU | ACUUCAAUUCCCAGAAAAGCC | | [1726-1746](21/21) 3'UTR |
| 133 | CCAAAUGUAGUCUCUUUUCUU | AAGAAAAGAGACUACAUUUGG | | [891-911](21/21) 3'UTR |
| 134 | AGCUGUAUACUACCACUUUGA | UCAAAGUGGUAGUAUACAGCU | | [1779-1799](21/21) 3'UTR |
| 135 | UAACCAUGCAUGCACCCAGAU | AUCUGGGUGCAUGCAUGGUUA | | [1890-1910](21/21) 3'UTR |
| 136 | CUGGGAUUAUGUUGUUCCUGA | UCAGGAACAACAUAAUCCCAG | Chimp | [305-325](21/21) ORF |
| 137 | GGGCAUCGAUGUAGAACUGUU | AACAGUUCUACAUCGAUGCCC | | [2422-2442](21/21) 3'UTR |
| 138 | CUGAGAAACUGACCCAGAAA | UUCUCUGGGUCAGUUUCUCAG | Chin, GP, Chimp, Rat, Ms | [445-465](21/21) ORF |
| 139 | GGUGUUGUUUAGAUGCCUUU | AAAGGCAUCUAAAACAACACC | | [1450-1470](21/21) 3'UTR |
| 140 | CUGGCAGUUUGAGCAGCAAGA | UCUUGCUGCUCAAACUGCCAG | Chimp | [214-234](21/21) ORF |
| 141 | CAUUUCACCAUGGCAGUGUUA | UAACACUGCCAUGGUGAAAUG | | [1694-1714](21/21) 3'UTR |
| 142 | UUCCAUUGAGUGAAUGAUGAA | UUCAUCAUUCACUCAAUGGAA | | [1570-1590](21/21) 3'UTR |
| 143 | GGUUGUGUUAUGCACGUGAAC | GUUCACGUGCAUAACACAACC | Ms | [516-536](21/21) ORF |
| 144 | CAGUAACCACGGUGUUGUUUU | AAAACAACACCGUGGUUACUG | | [1440-1460](21/21) 3'UTR |
| 145 | AGGAGAACUGCUCAUGGACUA | UAGUCCAUGAGCAGUUCUCCU | Dog, Chimp | [628-648](21/21) ORF |
| 146 | CCUGUUCUUAAGUGUUGAAUA | UAUUCAACACUUAAGAACAGG | | [1486-1506](21/21) 3'UTR |
| 147 | UCAUCCUGGUGUUACUGAAAA | UUUUCAGUAACACCAGGAUGA | | [2163-2183](21/21) 3'UTR |
| 148 | UGAAGGGUCCUAAAAGGGAA | UUCCCUUUUAGGACCCUUCA | | [773-793](21/21) ORF + 3'UTR |
| 149 | GCUAUGGAGAUAUGGUUUAUA | UAUAAACCAUAUCUCCAUAGC | | [1836-1856](21/21) 3'UTR |
| 150 | UUAGCCAGUUCUAACAAAC | GUUUGUUAGAACACUGGCUAA | | [2239-2259](21/21) 3'UTR |
| 151 | GGGUUUUUAGACAGGAAGGUA | UACCUUCCUGUCUAAAAACCC | | [1271-1291](21/21) 3'UTR |
| 152 | UGUCUAUUGUUAAGCUCCAAA | UUUGGAGCUUAACAAUAGACA | | [2341-2361](21/21) 3'UTR |

TABLE C-continued 21 mers

| Number | Sense siRNA | AntiSense siRNA | Other Sp | Hum-34222182 ORF: 204-785 |
|---|---|---|---|---|
| 153 | GAAUACCUGUGAGGAUAGGAA | UUCCUAUCCUCACAGGUAUUC | | [1588-1608](21/21) 3'UTR |
| 154 | CCUGUCACUAGGGAAUAAUAA | UUAUUAUUCCCUAGUGACAGG | | [1928-1948](21/21) 3'UTR |
| 155 | UAUUCAUCCUGGUGUUACUGA | UCAGUAACACCAGGAUGAAUA | | [2160-2180](21/21) 3'UTR |
| 156 | GGAAUCAACUUGCCAGAAUUU | AAAUUCUGGCAAGUUGAUUCC | Chimp | [353-373](21/21) ORF |
| 157 | UGUAAAAAGCUGGAUAGGAUU | AAUCCUAUCCAGCUUUUUACA | Chin, GP, Chimp, Rat | [555-575](21/21) ORF |
| 158 | UGGAUAGGAUUGUGUGUGAUU | AAUCACACACAAUCCUAUCCA | Chimp | [565-585](21/21) ORF |
| 159 | CUGUAUACUACCACUUUGAAU | AUUCAAAGUGGUAGUAUACAG | | [1781-1801](21/21) 3'UTR |
| 160 | GGAUAGGAAAUUAGUUCUGAG | CUCAGAACUAAUUUCCUAUCC | | [1600-1620](21/21) 3'UTR |
| 161 | AAACUAAACUUGGUUGCUCAA | UUGAGCAACCAAGUUUAGUUU | Chimp | [412-432](21/21) ORF |
| 162 | CAGAUUUUUCCACCUUGGAU | AUCCAAGGUGGAAAAAUCUG | | [1906-1926](21/21) 3'UTR |
| 163 | AAGGUAGGAUUAAGUAGGUGA | UCACCUACUUAAUCCUACCUU | | [1286-1306](21/21) 3'UTR |
| 164 | AGAACUGUCUGUCCAAAUCAA | UUGAUUUGGACAGACAGUUCU | Dog, Chimp | [388-408](21/21) ORF |
| 165 | CAUAGAUCCCAUUUUUGUACA | UGUACAAAAAUGGGAUCUAUG | | [999-1019](21/21) 3'UTR |
| 166 | GAUUCUAGCGUCGUACCUACU | AGUAGGUACGACGCUAGAAUC | | [582-602](21/21) ORF |
| 167 | CCAGAGAGCCUGCUAAGUGAU | AUCACUUAGCAGGCUCUCUGG | Chimp | [276-296](21/21) ORF |
| 168 | CACUUAGUAAUCUAUCCUCUU | AAGAGGAUAGAUUACUAAGUG | | [1640-1660](21/21) 3'UTR |
| 169 | ACUUCCUCACUCUAAUGUUUU | AAAACAUUAGAGUGAGGAAGU | | [1388-1408](21/21) 3'UTR |
| 170 | CCUGAGAAACUGACCCAGAGA | UCUCUGGGUCAGUUUCUCAGG | Chin, GP, Chimp, Rat, Ms | [444-464](21/21) ORF |
| 171 | AGGUUGUGUUAUGCACGUGAA | UUCACGUGCAUAACACAACCU | | [515-535](21/21) ORF |
| 172 | GCCUUUGGAGAAGUGAUUCAA | UUGAAUCACUUCUCCAAAGGC | | [960-980](21/21) 3'UTR |
| 173 | GAGAACUGUCUGUCCAAAUCA | UGAUUUGGACAGACAGUUCUC | Dog, Chimp | [387-407](21/21) ORF |
| 174 | AACUCUUCAAAUGCUGGAAA | UUUCCAAGCAUUUGAAGAGUU | | [2262-2282](21/21) 3'UTR |
| 175 | CAACGAGGUAAUAUUUGAGGA | UCCUCAAAUAUUACCUCGUUG | Chimp | [335-355](21/21) ORF |
| 176 | GGAAUAGGUAAGCAAAAGUAG | CUACUUUUGCUUACCUAUUCC | | [1034-1054](21/21) 3'UTR |
| 177 | GUGUAGAUUUUCUGCAUAGAU | AUCUAUGCAGAAAAUCUACAC | | [985-1005](21/21) 3'UTR |
| 178 | CACUCAACAAUGUUCAAUUCA | UGAAUUGAACAUUGUUGAGUG | | [2029-2049](21/21) 3'UTR |
| 179 | UCAACAAUGUUCAAUUCAGCA | UGCUGAAUUGAACAUUGUUGA | | [2032-2052](21/21) 3'UTR |
| 180 | GAAUUGGGCCAAGAUAAAUCA | UGAUUUAUCUUGGCCCAAUUC | | [2307-2327](21/21) 3'UTR |
| 181 | CUGUUAUGCUUACAAAAUGGU | ACCAUUUUGUAAGCAUAACAG | | [2481-2501](21/21) 3'UTR |
| 182 | GUCUGUCCAAAUCAAAGCAAA | UUUGCUUUGAUUUGGACAGAC | Dog, Chimp | [394-414](21/21) ORF |
| 183 | GGAAUUGAAGUAUCUCUCCUU | AAGGAGAGAUACUUCAAUUCC | | [1736-1756](21/21) 3'UTR |
| 184 | GAAGUCUGCAUUGGCUAUGGA | UCCAUAGCCAAUGCAGACUUC | | [1823-1843](21/21) 3'UTR |
| 185 | CUCUCUGAUUCACUUAGUAAU | AUUACUAAGUGAAUCAGAGAG | | [1630-1650](21/21) 3'UTR |
| 186 | AGUCCCUCUCUGAUUCACUUA | UAAGUGAAUCAGAGAGGGACU | | [1625-1645](21/21) 3'UTR |
| 187 | GGGUCCUAAAAGGGAAAAUA | UAUUUUCCCUUUUAGGACCC | | [777-797](21/21) ORF + 3'UTR |
| 188 | CAACCUCAACGAGGUAAUAUU | AAUAUUACCUCGUUGAGGUUG | Chimp | [329-349](21/21) ORF |
| 189 | CUAUUCAGCUAGUCAGCUAAA | UUUAGCUGACUAGCUGAAUAG | | [830-850](21/21) 3'UTR |
| 190 | GAUUGGAACAACAGUGAUUGA | UCAAUCACUGUUGUUCCAAUC | | [755-775](21/21) ORF |

TABLE C-continued 21 mers

| Number | Sense siRNA | AntiSense siRNA | Other Sp | Hum-34222182 ORF: 204-785 |
|---|---|---|---|---|
| 191 | AGAUCUAGUCCCUCUCUGAUU | AAUCAGAGAGGGACUAGAUCU | | [1619-1639](21/21) 3'UTR |
| 192 | UUACGAAGUCUGCAUUGGCUA | UAGCCAAUGCAGACUUCGUAA | | [1819-1839](21/21) 3'UTR |
| 193 | GCUUUUCUGGGAAUUGAAGUA | UACUUCAAUUCCCAGAAAAGC | | [1727-1747](21/21) 3'UTR |
| 194 | GAAGGGUUUUUAGACAGGAAG | CUUCCUGUCUAAAAACCCUUC | | [1268-1288](21/21) 3'UTR |
| 195 | GGCUUCUUGGGCAUCGAUGUA | UACAUCGAUGCCCAAGAAGCC | | [2414-2434](21/21) 3'UTR |
| 196 | UGGUUGCAACUGGCAGUUUGA | UCAAACUGCCAGUUGCAACCA | Chimp | [205-225](21/21) ORF |
| 197 | ACCAGAUUUGCCUAUUUUGAU | AUCAAAAUAGGCAAAUCUGGU | | [1124-1144](21/21) 3'UTR |
| 198 | UGUUAUGCACGUGAACUUGGA | UCCAAGUUCACGUGCAUAACA | Dog, Chin, GP, Rat, Ms | [521-541](21/21) ORF |
| 199 | UGGUGACUUCCUCACUCUAAU | AUUAGAGUGAGGAAGUCACCA | | [1383-1403](21/21) 3'UTR |
| 200 | CAUGCACCCAGAUUUUUUCCA | UGGAAAAAUCUGGGUGCAUG | | [1898-1918](21/21) 3'UTR |
| 201 | UGGCUUAUGGAAGGCUGUUAA | UUAACAGCCUUCCAUAAGCCA | | [2504-2524](21/21) 3'UTR |
| 202 | UGUUCCUGAACCCAACCUCAA | UUGAGGUUGGGUUCAGGAACA | Chimp | [317-337](21/21) ORF |
| 203 | GACAGGAAGGUAGGAUUAAGU | ACUUAAUCCUACCUUCCUGUC | | [1280-1300](21/21) 3'UTR |
| 204 | CUUAACCCUAGGUAAGAGUAA | UUACUCUUACCUAGGGUUAAG | | [1319-1339](21/21) 3'UTR |
| 205 | CUUUACUCACUGAUUGGAACA | UGUUCCAAUCAGUGAGUAAAG | | [744-764](21/21) ORF |
| 206 | ACCACCAGUUCCUGACUCAAA | UUUGAGUCAGGAACUGGUGGU | | [1244-1264](21/21) 3'UTR |
| 207 | GGGCCAAGAUAAAUCAAUGUU | AACAUUGAUUUAUCUUGGCCC | | [2312-2332](21/21) 3'UTR |
| 208 | UGAAACGGGUCAAUUUACGAA | UUCGUAAAUUGACCCGUUUCA | | [1805-1825](21/21) 3'UTR |
| 209 | CAAGGCUUCUUGGGCAUCGAU | AUCGAUGCCCAAGAAGCCUUG | | [2411-2431](21/21) 3'UTR |
| 210 | CACCACCAGUUCCUGACUCAA | UUGAGUCAGGAACUGGUGGUG | | [1243-1263](21/21) 3'UTR |
| 211 | UGAGGAAUCAACUUGCCAGAA | UUCUGGCAAGUUGAUUCCUCA | Chimp | [350-370](21/21) ORF |
| 212 | AAUUCAGCAAGGCUUUCAUAU | AUAUGAAAGCCUUGCUGAAUU | | [2044-2064](21/21) 3'UTR |
| 213 | CUUUAUAGAAUUGGGCCAAGA | UCUUGGCCCAAUUCUAUAAAG | | [2300-2320](21/21) 3'UTR |
| 214 | UGACCAUGGUUGCAACUGGCA | UGCCAGUUGCAACCAUGGUCA | Chimp | [199-219](21/21) 5'UTR + ORF |
| 215 | UGAUUUCUGGCCUUUGGAGA | UCUCCAAAGGCCAGAAAAUCA | | [950-970](21/21) 3'UTR |
| 216 | UAGGGAAUAAUAAAGGCCUUA | UAAGGCCUUUAUUAUUCCCUA | | [1936-1956](21/21) 3'UTR |
| 217 | CCUCAACGAGGUAAUAUUUGA | UCAAAUAUUACCUCGUUGAGG | Chimp | [332-352](21/21) ORF |
| 218 | GGGAAUAAUAAAGGCCUUAUU | AAUAAGGCCUUUAUUAUUCCC | | [1938-1958](21/21) 3'UTR |
| 219 | GUAGGCUUGGUAAUAGACUAU | AUAGUCUAUUACCAAGCCUAC | | [1099-1119](21/21) 3'UTR |
| 220 | UGUCUGUCCAAAUCAAAGCAA | UUGCUUUGAUUUGGACAGACA | Dog, Chimp | [393-413](21/21) ORF |
| 221 | CUUGUGGUGCCAUUUCAGUAA | UUACUGAAAUGGCACCACAAG | | [1425-1445](21/21) 3'UTR |
| 222 | CCCAUUUUUGUACAGAAUUGA | UCAAUUCUGUACAAAAAUGGG | | [1006-1026](21/21) 3'UTR |
| 223 | GGUAGUAAAACUAUUCAGCUA | UAGCUGAAUAGUUUUACUACC | | [820-840](21/21) 3'UTR |
| 224 | UUAUGCACGUGAACUUGGAAA | UUUCCAAGUUCACGUGCAUAA | Dog, Chin, GP, Rat | [523-543](21/21) ORF |
| 225 | UUGGUGACUUCCUCACUCUAA | UUAGAGUGAGGAAGUCACCAA | | [1382-1402](21/21) 3'UTR |
| 226 | UUGAAUGGGAUGGAAUAGGUA | UACCUAUUCCAUCCCAUUCAA | | [1023-1043](21/21) 3'UTR |
| 227 | UGGAAUAGGUAAGCAAAAGUA | UACUUUUGCUUACCUAUUCCA | | [1033-1053](21/21) 3'UTR |
| 228 | AAUGCUUGGAAAGAUACUACA | UGUAGUAUCUUUCCAAGCAUU | | [2271-2291](21/21) 3'UTR |

TABLE C-continued 21 mers

| Number | Sense siRNA | AntiSense siRNA | Other Sp | Hum-34222182 ORF: 204-785 |
|---|---|---|---|---|
| 229 | UUGUCAAGGGUAGUAGCUGUA | UACAGCUACUACCCUUGACAA | | [1765-1785](21/21) 3'UTR |
| 230 | GCUUCUCCUCUGGUUUCAGGA | UCCUGAAACCAGAGGAGAAGC | | [679-699](21/21) ORF |
| 231 | GGACUAGCUUCAGGGACUUUU | AAAAGUCCCUGAAGCUAGUCC | Chimp | [643-663](21/21) ORF |
| 232 | GGUUUUUAGACAGGAAGGUAG | CUACCUUCCUGUCUAAAAACC | | [1272-1292](21/21) 3'UTR |
| 233 | CAACUUGCCAGAAUUUGGUUA | UAACCAAAUUCUGGCAAGUUG | Chimp | [358-378](21/21) ORF |
| 234 | UUCUUGGGCAUCGAUGUAGAA | UUCUACAUCGAUGCCCAAGAA | | [2417-2437](21/21) 3'UTR |
| 235 | UAACCACGGUGUUGUUUUAGA | UCUAAAACAACACCGUGGUUA | | [1443-1463](21/21) 3'UTR |
| 236 | UGGUUUCAGGUAGGCUUGGUA | UACCAAGCCUACCUGAAACCA | | [1090-1110](21/21) 3'UTR |
| 237 | CUAGCUAUUAGCUCCACUUCA | UGAAGUGGAGCUAAUAGCUAG | | [2110-2130](21/21) 3'UTR |
| 238 | ACUGAUACUAUAAGUGACCUA | UAGGUCACUUAUAGUAUCAGU | | [2201-2221](21/21) 3'UTR |
| 239 | CUUGCCAGAAUUUGGUUAAAA | UUUUAACCAAAUUCUGGCAAG | Chimp | [361-381](21/21) ORF |
| 240 | CCCACCUGCCCUAAAUAAGAA | UUCUUAUUUAGGGCAGGUGGG | | [867-887](21/21) 3'UTR |
| 241 | CAGGAAGGUAGGAUUAAGUAG | CUACUUAAUCCUACCUUCCUG | | [1282-1302](21/21) 3'UTR |
| 242 | CGGCUUGCGAGGUUGUGUUAU | AUAACACAACCUCGCAAGCCG | Chimp | [506-526](21/21) ORF |
| 243 | AAUACCUGUGAGGAUAGGAAA | UUUCCUAUCCUCACAGGUAUU | | [1589-1609](21/21) 3'UTR |
| 244 | GAUAGGAUUGUGUGUGAUUCU | AGAAUCACACACAAUCCUAUC | Chimp | [567-587](21/21) ORF |
| 245 | GACUCAAAUUUGAAGGGUUUU | AAAACCCUUCAAAUUUGAGUC | | [1257-1277](21/21) 3'UTR |
| 246 | CUUGCCUGUUAUGCUUACAAA | UUUGUAAGCAUAACAGGCAAG | | [2476-2496](21/21) 3'UTR |
| 247 | CAGCUAGUCAGCUAAAGUCAU | AUGACUUUAGCUGACUAGCUG | | [835-855](21/21) 3'UTR |
| 248 | GUACCUACUUUUGAGCUUACA | UGUAAGCUCAAAAGUAGGUAC | | [594-614](21/21) ORF |
| 249 | UCAGGAGAACUCUGAUCCUCA | UGAGGAUCAGAGUUCUCCUGA | | [694-714](21/21) ORF |
| 250 | GAGGUAAUAUUUGAGGAAUCA | UGAUUCCUCAAAUAUUACCUC | Chimp | [339-359](21/21) ORF |
| 251 | CGAGGUAAUAUUUGAGGAAUC | GAUUCCUCAAAUAUUACCUCG | Chimp | [338-358](21/21) ORF |
| 252 | CAAUAAUGGAACUGCUUCACU | AGUGAAGCAGUUCCAUUAUUG | | [1356-1376](21/21) 3'UTR |
| 253 | AAAGGUCCUUGUCCCUGAGAA | UUCUCAGGGACAAGGACCUUU | Chimp | [431-451](21/21) ORF |
| 254 | UAGCGUCGUACCUACUUUUGA | UCAAAAGUAGGUACGACGCUA | | [587-607](21/21) ORF |
| 255 | CCAGAUUUGCCUAUUUUGAUU | AAUCAAAAUAGGCAAAUCUGG | | [1125-1145](21/21) 3'UTR |
| 256 | CAGGUUUCCUGCCCUAGCUAU | AUAGCUAGGGCAGGAAACCUG | | [2097-2117](21/21) 3'UTR |
| 257 | GUUUAUAGUACAGCCUAGAGA | UCUCUAGGCUGUACUAUAAAC | | [1850-1870](21/21) 3'UTR |
| 258 | GACAGAUGUAUUCAUCCUGGU | ACCAGGAUGAAUACAUCUGUC | | [2152-2172](21/21) 3'UTR |
| 259 | GUGUUCUAACAAACUAAACUC | GAGUUUAGUUUGUUAGAACAC | | [2246-2266](21/21) 3'UTR |
| 260 | GGAAGGUAGGAUUAAGUAGGU | ACCACUUAAUCCUACCUUCC | | [1284-1304](21/21) 3'UTR |
| 261 | AACGAGGUAAUAUUUGAGGAA | UUCCUCAAAUAUUACCUCGUU | Chimp | [336-356](21/21) ORF |
| 262 | UAGUACAGCCUAGAGAAUGAA | UUCAUUCUCUAGGCUGUACUA | | [1855-1875](21/21) 3'UTR |
| 263 | AGCUCAGGAUUUCGACUUGUU | AACAAGUCGAAAUCCUGAGCU | | [714-734](21/21) ORF |
| 264 | CAGGUAGGCUUGGUAAUAGAC | GUCUAUUACCAAGCCUACCUG | | [1096-1116](21/21) 3'UTR |
| 265 | AAGGGUCCUAAAAAGGGAAAA | UUUUCCCUUUUUAGGACCCUU | | [775-795](21/21) ORF + 3'UTR |
| 266 | AGAUCCCAUUUUUGUACAGAA | UUCUGUACAAAAAUGGGAUCU | | [1002-1022](21/21) 3'UTR |

TABLE C-continued

21 mers

| Number | Sense siRNA | AntiSense siRNA | Other Sp | Hum-34222182 ORF: 204-785 |
|---|---|---|---|---|
| 267 | GCUUAAUCUCAGAUGAACCAU | AUGGUUCAUCUGAGAUUAAGC | | [1676-1696](21/21) 3'UTR |
| 268 | GGAUACCUGUCACUAGGGAAU | AUUCCCUAGUGACAGGUAUCC | | [1923-1943](21/21) 3'UTR |
| 269 | CACCAGUUCCUGACUCAAAUU | AAUUUGAGUCAGGAACUGGUG | | [1246-1266](21/21) 3'UTR |
| 270 | CUUCCAUUGAGUGAAUGAUGA | UCAUCAUUCACUCAAUGGAAG | | [1569-1589](21/21) 3'UTR |
| 271 | CUUUGAAUUAUUGAAACGGGU | ACCCGUUUCAAUAAUUCAAAG | | [1794-1814](21/21) 3'UTR |
| 272 | GCCUGCUAAGUGAUUUUGACU | AGUCAAAAUCACUUAGCAGGC | Chimp | [283-303](21/21) ORF |
| 273 | CAAAUUAGCCAGUGUUCUAAC | GUUAGAACACUGGCUAAUUUG | | [2235-2255](21/21) 3'UTR |
| 274 | CUUUGACUCUCUUGCCUGUUA | UAACAGGCAAGAGAGUCAAAG | | [2466-2486](21/21) 3'UTR |
| 275 | CAGGUGUGAUCCUGUUACUGA | UCAGUAACAGGAUCACACCUG | | [2185-2205](21/21) 3'UTR |
| 276 | AACUUUACUCACUGAUUGGAA | UUCCAAUCAGUGAGUAAAGUU | | [742-762](21/21) ORF |
| 277 | UCCUUGUCCCUGAGAAACUGA | UCAGUUUCUCAGGGACAAGGA | Dog, Chimp | [436-456](21/21) ORF |
| 278 | AAAUGGUGAUGGCUUAUGGA | UCCAUAAGCCAUCACCAUUUU | | [2494-2514](21/21) 3'UTR |
| 279 | AAAUUAGCCAGUGUUCUAACA | UGUUAGAACACUGGCUAAUUU | | [2236-2256](21/21) 3'UTR |
| 280 | GAAUGGGAUGGAAUAGGUAAG | CUUACCUAUUCCAUCCCAUUC | | [1025-1045](21/21) 3'UTR |
| 281 | GCUUAUGGAAGGCUGUUAAAU | AUUUAACAGCCUUCCAUAAGC | | [2506-2526](21/21) 3'UTR |
| 282 | AAGGGUAGUAGCUGUAUACUA | UAGUAUACAGCUACUACCCUU | | [1770-1790](21/21) 3'UTR |
| 283 | UGAAACUCACCGUCCAGAUAA | UUAUCUGGACGGUGAGUUUCA | | [1872-1892](21/21) 3'UTR |
| 284 | CUAGCUUCAGGGACUUUUUCU | AGAAAAAGUCCCUGAAGCUAG | Chimp | [646-666](21/21) ORF |
| 285 | UACUCACUGAUUGGAACAACA | UGUUGUUCCAAUCAGUGAGUA | | [747-767](21/21) ORF |
| 286 | AAGUGAUUUUGACUACUGGGA | UCCCAGUAGUCAAAAUCACUU | Chimp | [290-310](21/21) ORF |
| 287 | GGCAAUAAUGGAACUGCUUCA | UGAAGCAGUUCCAUUAUUGCC | | [1354-1374](21/21) 3'UTR |
| 288 | GGGUAGUAAAACUAUUCAGCU | AGCUGAAUAGUUUUACUACCC | | [819-839](21/21) 3'UTR |
| 289 | CUGCAUAGAUCCCAUUUUUGU | ACAAAAAUGGGAUCUAUGCAG | | [996-1016](21/21) 3'UTR |
| 290 | GUUUUAAAGAGGCAACAAAAG | CUUUUGUUGCCUCUUUAAAAC | | [1404-1424](21/21) 3'UTR |
| 291 | GAACCCAACCUCAACGAGGUA | UACCUCGUUGAGGUUGGGUUC | Chimp | [324-344](21/21) ORF |
| 292 | AGCUAUUAGCUCCACUUCACA | UGUGAAGUGGAGCUAAUAGCU | | [2112-2132](21/21) 3'UTR |
| 293 | CUUUCUGUGUUUCACAUUCAU | AUGAAUGUGAAACACAGAAAG | | [909-929](21/21) 3'UTR |
| 294 | CAGAAUUGCUGGACUGUGGCU | AGCCACAGUCCAGCAAUUCUG | Chimp | [250-270](21/21) ORF |
| 295 | CAAACUAAACUUGGUUGCUCA | UGAGCAACCAAGUUUAGUUUG | Chimp | [411-431](21/21) ORF |
| 296 | CUUCUUGGGCAUCGAUGUAGA | UCUACAUCGAUGCCCAAGAAG | | [2416-2436](21/21) 3'UTR |
| 297 | GUCAAGGGUAGUAGCUGUAUA | UAUACAGCUACUACCCUUGAC | | [1767-1787](21/21) 3'UTR |
| 298 | UCAGGUUUCCUGCCCUAGCUA | UAGCUAGGGCAGGAAACCUGA | | [2096-2116](21/21) 3'UTR |
| 299 | CGAUGUAGAACUGUUGUCCUU | AAGGACAACAGUUCUACAUCG | | [2428-2448](21/21) 3'UTR |
| 300 | UGGGCAUCGAUGUAGAACUGU | ACAGUUCUACAUCGAUGCCCA | | [2421-2441](21/21) 3'UTR |
| 301 | GGUAGUAGCUGUAUACUACCA | UGGUAGUAUACAGCUACUACC | | [1773-1793](21/21) 3'UTR |
| 302 | CUCUUUUCUUCUGUGUUUCA | UGAAACACAGAAGAAAAGAG | | [902-922](21/21) 3'UTR |
| 303 | CUGGAGAACUGUCUGUCCAAA | UUUGGACAGACAGUUCUCCAG | Dog, Chimp | [384-404](21/21) ORF |
| 304 | UUGUCACCACUGACUGGGCAA | UUGCCCAGUCAGUGGUGACAA | | [2393-2413](21/21) 3'UTR |

TABLE C-continued 21 mers

| Number | Sense siRNA | AntiSense siRNA | Other Sp | Hum-34222182 ORF: 204-785 |
|---|---|---|---|---|
| 305 | CCAAAUCAAAGCAAACUAAAC | GUUUAGUUUGCUUUGAUUUGG | Chimp | [400-420](21/21) ORF |
| 306 | GCUUGGAAAGAUACUACAAAG | CUUUGUAGUAUCUUUCCAAGC | | [2274-2294](21/21) 3'UTR |
| 307 | GGCAGUGUUAUCUCAUCUCUG | CAGAGAUGAGAUAACACUGCC | | [1705-1725](21/21) 3'UTR |
| 308 | ACAGAAUUGAAUGGGAUGGAA | UUCCAUCCCAUUCAAUUCUGU | | [1017-1037](21/21) 3'UTR |
| 309 | CACUGAUUGGAACAACAGUGA | UCACUGUUGUUCCAAUCAGUG | | [751-771](21/21) ORF |
| 310 | GCUUAACCCUAGGUAAGAGUA | UACUCUUACCUAGGGUUAAGC | | [1318-1338](21/21) 3'UTR |
| 311 | UCUUGCCUGUUAUGCUUACAA | UUGUAAGCAUAACAGGCAAGA | | [2475-2495](21/21) 3'UTR |
| 312 | CACUAACAGUUAUCUUUGACU | AGUCAAAGAUAACUGUUAGUG | | [2453-2473](21/21) 3'UTR |
| 313 | GAGAGCCUGCUAAGUGAUUUU | AAAAUCACUUAGCAGGCUCUC | Chimp | [279-299](21/21) ORF |
| 314 | ACACCACCAGUUCCUGACUCA | UGAGUCAGGAACUGGUGGUGU | | [1242-1262](21/21) 3'UTR |
| 315 | GAUUAUUUCAUGAUUGGGUAG | CUACCCAAUCAUGAAAUAAUC | | [804-824](21/21) 3'UTR |
| 316 | AUGCUUGGAAAGAUACUACAA | UUGUAGUAUCUUUCCAAGCAU | | [2272-2292](21/21) 3'UTR |
| 317 | UGCAUAGAUCCCAUUUUUGUA | UACAAAAUGGGAUCUAUGCA | | [997-1017](21/21) 3'UTR |
| 318 | UAGGCUUGGUAAUAGACUAUA | UAUAGUCUAUUACCAAGCCUA | | [1100-1120](21/21) 3'UTR |
| 319 | UGAUUUGACUACUGGGAUUA | UAAUCCCAGUAGUCAAAAUCA | Dog, Chimp | [293-313](21/21) ORF |
| 320 | UGGUUUUAUAGUACAGCCUAGA | UCUAGGCUGUACUAUAAACCA | | [1848-1868](21/21) 3'UTR |
| 321 | CUGCAUUGGCUAUGGAGAUAU | AUAUCUCCAUAGCCAAUGCAG | | [1828-1848](21/21) 3'UTR |
| 322 | UUAUAGAAUUGGGCCAAGAUA | UAUCUUGGCCCAAUUCUAUAA | | [2302-2322](21/21) 3'UTR |
| 323 | GAUACUACAAAGCCAAUCUUU | AAAGAUUGGCUUUGUAGUAUC | | [2283-2303](21/21) 3'UTR |
| 324 | CAGCAAGGCUUUCAUAUCCUU | AAGGAUAUGAAAGCCUUGCUG | | [2048-2068](21/21) 3'UTR |
| 325 | GAAUUGCUGGACUGUGGCUAU | AUAGCCACAGUCCAGCAAUUC | Chimp | [252-272](21/21) ORF |
| 326 | CAGGAUUUCGACUUGUUAAGA | UCUUAACAAGUCGAAAUCCUG | | [718-738](21/21) ORF |
| 327 | GGUCCUUGUCCCUGAGAAACU | AGUUUCUCAGGGACAAGGACC | Chimp | [434-454](21/21) ORF |
| 328 | UGGUGUUACUGAAAAACAGGU | ACCUGUUUUUCAGUAACACCA | | [2169-2189](21/21) 3'UTR |
| 329 | AGUGAAUGAUGAAUACCUGUG | CACAGGUAUUCAUCAUUCACU | | [1578-1598](21/21) 3'UTR |
| 330 | CAGUUAUCUUUGACUCUCUUG | CAAGAGAGUCAAAGAUAACUG | | [2459-2479](21/21) 3'UTR |
| 331 | ACGGCAAUAAUGGAACUGCUU | AAGCAGUUCCAUUAUUGCCGU | | [1352-1372](21/21) 3'UTR |
| 332 | AUUUGAGGAAUCAACUUGCCA | UGGCAAGUUGAUUCCUCAAAU | Chimp | [347-367](21/21) ORF |
| 333 | CCAACCUCAACGAGGUAAUAU | AUAUUACCUCGUUGAGGUUGG | Chimp | [328-348](21/21) ORF |
| 334 | CCCUGUUCUUAAGUGUUGAAU | AUUCAACACUUAAGAACAGGG | | [1485-1505](21/21) 3'UTR |
| 335 | GAACCAUUUCACCAUGGCAGU | ACUGCCAUGGUGAAAUGGUUC | | [1690-1710](21/21) 3'UTR |
| 336 | CAGCCUAGAGAAUGAAACUCA | UGAGUUUCAUUCUCUAGGCUG | | [1860-1880](21/21) 3'UTR |
| 337 | AGCCUAUCAAAACUUCCAAAA | UUUUGGAAGUUUUGAUAGGCU | | [1217-1237](21/21) 3'UTR |
| 338 | CUUGCGAGGUUGUGUUAUGCA | UGCAUAACACAACCUCGCAAG | Chimp | [509-529](21/21) ORF |
| 339 | UAGAAGCCCAUUUGAGUUUUA | UAAAACUCAAAUGGGCUUCUA | | [1052-1072](21/21) 3'UTR |
| 340 | ACCUGUCACUAGGGAAUAUAU | AUAUAUUCCCUAGUGACAGGU | | [1927-1947](21/21) 3'UTR |
| 341 | AGUCAGCUAAAGUCAUUUGUA | UACAAAUGACUUUAGCUGACU | | [840-860](21/21) 3'UTR |
| 342 | CAGUAUUACAUGUGCUUAAUC | GAUUAAGCACAUGUAAUACUG | | [1663-1683](21/21) 3'UTR |

TABLE C-continued

21 mers

| Number | Sense siRNA | AntiSense siRNA | Other Sp | Hum-34222182 ORF: 204-785 |
|---|---|---|---|---|
| 343 | CACCCAGAUUUUUCCACCUU | AAGGUGGAAAAAAUCUGGGUG | | [1902-1922](21/21) 3'UTR |
| 344 | CUUACAAAAUGGUGAUGGCUU | AAGCCAUCACCAUUUUGUAAG | | [2489-2509](21/21) 3'UTR |
| 345 | UUUGGUUAAAAUGCUGGAGAA | UUCUCCAGCAUUUUAACCAAA | Chimp | [371-391](21/21) ORF |
| 346 | GAUUACUCUUCCAUUGAGUGA | UCACUCAAUGGAAGAGUAAUC | | [1562-1582](21/21) 3'UTR |
| 347 | CAUGUCUAUUGUUAAGCUCCA | UGGAGCUUAACAAUAGACAUG | | [2339-2359](21/21) 3'UTR |
| 348 | GCGUAGGGACAGAUGUAUUCA | UGAAUACAUCUGUCCCUACGC | | [2145-2165](21/21) 3'UTR |
| 349 | AGCCGUUGACCAUGGUUGCAA | UUGCAACCAUGGUCAACGGCU | Chimp, Rat, Ms | [193-213](21/21) 5'UTR + ORF |
| 350 | UUACAUGUGCUUAAUCUCAGA | UCUGAGAUUAAGCACAUGUAA | | [1668-1688](21/21) 3'UTR |
| 351 | AUCUCUGGGCUUUUCUGGGAA | UUCCCAGAAAAGCCCAGAGAU | | [1719-1739](21/21) 3'UTR |
| 352 | CCUUGUCCCUGAGAAACUGAC | GUCAGUUUCUCAGGGACAAGG | Dog, Chimp | [437-457](21/21) ORF |
| 353 | UAGAAUUGGGCCAAGAUAAAU | AUUUAUCUUGGCCCAAUUCUA | | [2305-2325](21/21) 3'UTR |
| 354 | AGGGACUUUUUCUUUAGUAGA | UCUACUAAAGAAAAAGUCCCU | | [654-674](21/21) ORF |
| 355 | UUGAGUGAAUGAUGAAUACCU | AGGUAUUCAUCAUUCACUCAA | | [1575-1595](21/21) 3'UTR |
| 356 | GCAUCGAUGUAGAACUGUUGU | ACAACAGUUCUACAUCGAUGC | | [2424-2444](21/21) 3'UTR |
| 357 | UUGAAACGGGUCAAUUUACGA | UCGUAAAUUGACCCGUUUCAA | | [1804-1824](21/21) 3'UTR |
| 358 | AAGUCUGCAUUGGCUAUGGAG | CUCCAUAGCCAAUGCAGACUU | | [1824-1844](21/21) 3'UTR |
| 359 | AUGUCUAUUGUUAAGCUCCAA | UUGGAGCUUAACAAUAGACAU | | [2340-2360](21/21) 3'UTR |
| 360 | AUUGGGCCAAGAUAAAUCAAU | AUUGAUUUAUCUUGGCCCAAU | | [2309-2329](21/21) 3'UTR |
| 361 | UGCUUAAUCUCAGAUGAACCA | UGGUUCAUCUGAGAUUAAGCA | | [1675-1695](21/21) 3'UTR |
| 362 | CAGCUAAAGUCAUUUGUAGUU | AACUACAAAUGACUUUAGCUG | | [843-863](21/21) 3'UTR |
| 363 | GAGAAUUGCUCAAGAUGUCCU | AGGACAUCUUGAGCAAUUCUC | Chimp, Ms | [461-481](21/21) ORF |
| 364 | GGCUAUGGAGAUAUGGUUUAU | AUAAACCAUAUCUCCAUAGCC | | [1835-1855](21/21) 3'UTR |
| 365 | GCCCUAGCUAUUAGCUCCACU | AGUGGAGCUAAUAGCUAGGGC | | [2107-2127](21/21) 3'UTR |
| 366 | CAGCAUUUCAGAAUUGCUGGA | UCCAGCAAUUCUGAAAUGCUG | Chimp | [242-262](21/21) ORF |
| 367 | CCUACUUUUGAGCUUACACUU | AAGUGUAAGCUCAAAAGUAGG | Chimp | [597-617](21/21) ORF |
| 368 | CCAGAGAAUUGCUCAAGAUGU | ACAUCUUGAGCAAUUCUCUGG | Chimp, Ms | [458-478](21/21) ORF |
| 369 | AGGUAGGCUUGGUAAUAGACU | AGUCUAUUACCAAGCCUACCU | | [1097-1117](21/21) 3'UTR |
| 370 | GAUUUUGACUACUGGGAUUAU | AUAAUCCCAGUAGUCAAAAUC | Chimp | [294-314](21/21) ORF |
| 371 | AUGAUGAAUACCUGUGAGGAU | AUCCUCACAGGUAUUCAUCAU | | [1583-1603](21/21) 3'UTR |
| 372 | GCUCCAAAGGUUCACUGUGUU | AACACAGUGAACCUUUGGAGC | | [2354-2374](21/21) 3'UTR |
| 373 | UGAUCCUGUUACUGAUACUAU | AUAGUAUCAGUAACAGGAUCA | | [2191-2211](21/21) 3'UTR |
| 374 | GUCAAUUUACGAAGUCUGCAU | AUGCAGACUUCGUAAAUUGAC | | [1813-1833](21/21) 3'UTR |
| 375 | GGAAACAGAGCCGUUGACCAU | AUGGUCAACGGCUCUGUUUCC | Dog, Chimp, Rat, Ms | [185-205](21/21) 5'UTR + ORF |
| 376 | GAAAACAGGUGUGAUCCUGU | ACAGGAUCACACCUGUUUUC | | [2179-2199](21/21) 3'UTR |
| 377 | UCAGGGACUUUUUCUUUAGUA | UACUAAAGAAAAAGUCCCUGA | | [652-672](21/21) ORF |
| 378 | UCAUGAUUGGGUAGUAAACU | AGUUUACUACCCAAUCAUGA | | [811-831](21/21) 3'UTR |
| 379 | CAUGGACUAGCUUCAGGGACU | AGUCCCUGAAGCUAGUCCAUG | Chimp | [640-660](21/21) ORF |
| 380 | GCGAGGUUGUGUUAUGCACGU | ACGUGCAUAACACAACCUCGC | | [512-532](21/21) ORF |

TABLE C-continued

21 mers

| Number | Sense siRNA | AntiSense siRNA | Other Sp | Hum-34222182 ORF: 204-785 |
|---|---|---|---|---|
| 381 | AACCCAACCUCAACGAGGUAA | UUACCUCGUUGAGGUUGGGUU | Chimp | [325-345](21/21) ORF |
| 382 | GAGAUAUGGUUUAUAGUACAG | CUGUACUAUAAACCAUAUCUC | | [1842-1862](21/21) 3'UTR |
| 383 | AGGUGUGAUCCUGUUACUGAU | AUCAGUAACAGGAUCACACCU | | [2186-2206](21/21) 3'UTR |
| 384 | GAGAAACUGACCCAGAGAAUU | AAUUCUCUGGGUCAGUUUCUC | Chin, GP, Chimp, Rat, Ms | [447-467](21/21) ORF |
| 385 | AGAUUUUCUGCAUAGAUCCCA | UGGGAUCUAUGCAGAAAAUCU | | [989-1009](21/21) 3'UTR |
| 386 | AGGAAUCAACUUGCCAGAAUU | AAUUCUGGCAAGUUGAUUCCU | Chimp | [352-372](21/21) ORF |
| 387 | CCAUGCAUGCACCCAGAUUUU | AAAAUCGGGUGCAUGCAUGG | | [1893-1913](21/21) 3'UTR |
| 388 | ACUGUUGUCCUUUUUCCACUA | UAGUGGAAAAAGGACAACAGU | | [2437-2457](21/21) 3'UTR |
| 389 | UAACCCUAGGUAAGAGUAAAU | AUUUACUCUUACCUAGGGUUA | | [1321-1341](21/21) 3'UTR |
| 390 | AUUCAUCCUGGUGUUACUGAA | UUCAGUAACACCAGGAUGAAU | | [2161-2181](21/21) 3'UTR |
| 391 | AGGGAAUAAUAAAGGCCUUAU | AUAAGGCCUUUAUUAUUCCCU | | [1937-1957](21/21) 3'UTR |
| 392 | UUGUUAAGCUCCAAAGGUUCA | UGAACCUUUGGAGCUUAACAA | | [2347-2367](21/21) 3'UTR |
| 393 | CUGGUUUCAGGAGAACUCUGA | UCAGAGUUCUCCUGAAACCAG | | [688-708](21/21) ORF |
| 394 | UGGAAAGAUACUACAAAGCCA | UGGCUUUGUAGUAUCUUUCCA | | [2277-2297](21/21) 3'UTR |
| 395 | CUCUGAUCCUCAGCUCAGGAU | AUCCUGAGCUGAGGAUCAGAG | | [703-723](21/21) ORF |
| 396 | CAACUGGCAGUUUGAGCAGCA | UGCUGCUCAAACUGCCAGUUG | Chimp | [211-231](21/21) ORF |
| 397 | UAAGCAAAAGUAGAAGCCCAU | AUGGGCUUCUACUUUUGCUUA | | [1042-1062](21/21) 3'UTR |
| 398 | GAUUUUCUGCAUAGAUCCCAU | AUGGGAUCUAUGCAGAAAAUC | | [990-1010](21/21) 3'UTR |
| 399 | GAGUUUUACAUUUGAUUCCAC | GUGGAAUCAAAUGUAAAACUC | | [1065-1085](21/21) 3'UTR |
| 400 | CUGCCCUAGCUAUUAGCUCCA | UGGAGCUAAUAGCUAGGGCAG | | [2105-2125](21/21) 3'UTR |
| 401 | UCCACUAACAGUUAUCUUUGA | UCAAAGAUAACUGUUAGUGGA | | [2451-2471](21/21) 3'UTR |
| 402 | AGGCUUGGUAAUAGACUAUAU | AUAUAGUCUAUUACCAAGCCU | | [1101-1121](21/21) 3'UTR |
| 403 | AAAGCUUGUGGUGCCAUUUCA | UGAAAUGGCACCACAAGCUUU | | [1421-1441](21/21) 3'UTR |
| 404 | UAGCCUAUCAAAACUUCCAAA | UUUGGAAGUUUUGAUAGGCUA | | [1216-1236](21/21) 3'UTR |
| 405 | GUCUUAUUCCAACUAAGUAGA | UCUACUUAGUUGGAAUAAGAC | | [1963-1983](21/21) 3'UTR |
| 406 | UCAGCUAAAGUCAUUUGUAGU | ACUACAAAUGACUUUAGCUGA | | [842-862](21/21) 3'UTR |
| 407 | CAACUGCAGCUAACAGGCUGA | UCAGCCUGUUAGCUGCAGUUG | | [932-952](21/21) 3'UTR |
| 408 | CGUCGUACCUACUUUUGAGCU | AGCUCAAAAGUAGGUACGACG | | [590-610](21/21) ORF |
| 409 | CAACAGUGAUUGAAGGGUCCU | AGGACCCUUCAAUCACUGUUG | | [763-783](21/21) ORF |
| 410 | GGAACUGCUUCACUGUUUCUU | AAGAAACAGUGAAGCAGUUCC | | [1363-1383](21/21) 3'UTR |
| 411 | CCCAGAUUUUUUCCACCUUGG | CCAAGGUGGAAAAAAUCUGGG | | [1904-1924](21/21) 3'UTR |
| 412 | CUUAAUCUCAGAUGAACCAUU | AAUGGUUCAUCUGAGAUUAAG | | [1677-1697](21/21) 3'UTR |
| 413 | AAAACAGGUGUGAUCCUGUUA | UAACAGGAUCACACCUGUUUU | | [2181-2201](21/21) 3'UTR |
| 414 | UGAGAUCUAGUCCCUCUCUGA | UCAGAGAGGGACUAGAUCUCA | | [1617-1637](21/21) 3'UTR |
| 415 | CAAAGCAAACUAAACUUGGUU | AACCAAGUUUAGUUUGCUUUG | Chimp | [406-426](21/21) ORF |
| 416 | UGGCAGUUUGAGCAGCAAGAA | UUCUUGCUGCUCAAACUGCCA | Chimp | [215-235](21/21) ORF |
| 417 | UGUUUCUGGUGACUUCCUCA | UGAGGAAGUCACCAAGAAACA | | [1376-1396](21/21) 3'UTR |
| 418 | UUCAAAUUAGCCAGUGUUCUA | UAGAACACUGGCUAAUUUGAA | | [2233-2253](21/21) 3'UTR |

TABLE C-continued 21 mers

| Number | Sense siRNA | AntiSense siRNA | Other Sp | Hum-34222182 ORF: 204-785 |
|---|---|---|---|---|
| 419 | ACUGCUUCACUGUUUCUUGGU | ACCAAGAAACAGUGAAGCAGU | | [1366-1386](21/21) 3'UTR |
| 420 | GACCCAGAGAAUUGCUCAAGA | UCUUGAGCAAUUCUCUGGGUC | Chimp, Ms | [455-475](21/21) ORF |
| 421 | GAAUUGAAGUAUCUCUCCUUA | UAAGGAGAGAUACUUCAAUUC | | [1737-1757](21/21) 3'UTR |
| 422 | AUCUAGUCCCUCUCUGAUUCA | UGAAUCAGAGAGGGACUAGAU | | [1621-1641](21/21) 3'UTR |
| 423 | UCAAAUGCUUGGAAAGAUACU | AGUAUCUUUCCAAGCAUUUGA | | [2268-2288](21/21) 3'UTR |
| 424 | CAAUUGUCAAGGGUAGUAGCU | AGCUACUACCCUUGACAAUUG | | [1762-1782](21/21) 3'UTR |
| 425 | CUGACUCAAAUUUGAAGGGUU | AACCCUUCAAAUUUGAGUCAG | | [1255-1275](21/21) 3'UTR |
| 426 | UUACAAAAUGGUGAUGGCUUA | UAAGCCAUCACCAUUUUGUAA | | [2490-2510](21/21) 3'UTR |
| 427 | UCUCUGGGCUUUUCGGGAAU | AUUCCCAGAAAAGCCCAGAGA | | [1720-1740](21/21) 3'UTR |
| 428 | CAAAAGCCCACACCACCAGUU | AACUGGUGGUGUGGGCUUUUG | | [1233-1253](21/21) 3'UTR |
| 429 | UAGGAUUGUGUGUGAUUCUAG | CUAGAAUCACACACAAUCCUA | Chimp | [569-589](21/21) ORF |
| 430 | CAAAUGCUUGGAAAGAUACUA | UAGUAUCUUUCCAAGCAUUUG | | [2269-2289](21/21) 3'UTR |
| 431 | CCUGUUACUGAUACUAUAAGU | ACUUAUAGUAUCAGUAACAGG | | [2195-2215](21/21) 3'UTR |
| 432 | GCACCCAGAUUUUUUCCACCU | AGGUGGAAAAAUCUGGGUGC | | [1901-1921](21/21) 3'UTR |
| 433 | CUCUAAUGUUUAAAGAGGCA | UGCCUCUUUAAAACAUUAGAG | | [1397-1417](21/21) 3'UTR |
| 434 | CAGUUCCUGACUCAAAUUUGA | UCAAAUUUGAGUCAGGAACUG | | [1249-1269](21/21) 3'UTR |
| 435 | GUCUCUUUUCUUCUGUGUUU | AAACACAGAAAGAAAAGAGAC | | [900-920](21/21) 3'UTR |
| 436 | UAGUGUAGAUUUUCUGCAUAG | CUAUGCAGAAAAUCUACACUA | | [983-1003](21/21) 3'UTR |
| 437 | GGUAGGAUUAAGUAGGUGAGU | ACUCACCUACUUAAUCCUACC | | [1288-1308](21/21) 3'UTR |
| 438 | GUGAUUCUAGCGUCGUACCUA | UAGGUACGACGCUAGAAUCAC | | [580-600](21/21) ORF |
| 439 | GGUUAAAAUGCUGGAGAACUG | CAGUUCUCCAGCAUUUUAACC | Chimp | [374-394](21/21) ORF |
| 440 | CUCAGAUGAACCAUUUCACCA | UGGUGAAAUGGUUCAUCUGAG | | [1683-1703](21/21) 3'UTR |
| 441 | UGAGAAACUGACCCAGAGAAU | AUUCUCUGGGUCAGUUUCUCA | Chin, GP, Chimp, Rat, Ms | [446-466](21/21) ORF |
| 442 | ACUUGGUUGCUCAAAGGUCCU | AGGACCUUUGAGCAACCAAGU | Chimp | [419-439](21/21) ORF |
| 443 | UAGGAUUAAGUAGGUGAGUUU | AAACUCACCUACUUAAUCCUA | | [1290-1310](21/21) 3'UTR |
| 444 | AGGAUUAAGUAGGUGAGUUUA | UAAACUCACCUACUUAAUCCU | | [1291-1311](21/21) 3'UTR |
| 445 | UCCUUUUUCCACUAACAGUUA | UAACUGUUAGUGGAAAAAGGA | | [2444-2464](21/21) 3'UTR |
| 446 | GAAGCCACCUGCUGUGUUUA | UAAACACAGCAGGUGGCUUC | | [94-114](21/21) 5'UTR |
| 447 | GCUUCUUGGGCAUCGAUGUAG | CUACAUCGAUGCCCAAGAAGC | | [2415-2435](21/21) 3'UTR |
| 448 | CUGUCUGUCCAAAUCAAAGCA | UGCUUUGAUUUGGACAGACAG | Dog, Chimp | [392-412](21/21) ORF |
| 449 | CUGGAUAGGAUUGUGUGUGAU | AUCACACACAAUCCUAUCCAG | Chin, GP, Chimp, Rat | [564-584](21/21) ORF |
| 450 | CUGGGCUUUUCGGGAAUUGA | UCAAUUCCCAGAAAAGCCCAG | | [1723-1743](21/21) 3'UTR |
| 451 | CUAACAGUUAUCUUUGACUCU | AGAGUCAAAGAUAACUGUUAG | | [2455-2475](21/21) 3'UTR |
| 452 | AUGUAAAAGCUGGAUAGGAU | AUCCUAUCCAGCUUUUUACAU | Chimp, Ms | [554-574](21/21) ORF |
| 453 | UCUCCUCUGGUUUCAGGAGAA | UUCUCCUGAAACCAGAGGAGA | | [682-702](21/21) ORF |
| 454 | GAUUUUUCCACCUUGGAUAC | GUAUCCAAGGUGGAAAAAUC | | [1908-1928](21/21) 3'UTR |
| 455 | AACUCACCGUCCAGAUAACCA | UGGUUAUCUGGACGGUGAGUU | | [1875-1895](21/21) 3'UTR |
| 456 | AGUGAUUUUGACUACUGGGAU | AUCCCAGUAGUCAAAAUCACU | Chimp | [291-311](21/21) ORF |

TABLE C-continued 21 mers

| Number | Sense siRNA | AntiSense siRNA | Other Sp | Hum-34222182 ORF: 204-785 |
|---|---|---|---|---|
| 457 | AUGGAAUAGGUAAGCAAAAGU | ACUUUUGCUUACCUAUUCCAU | | [1032-1052](21/21) 3'UTR |
| 458 | GAUGGAAUAGGUAAGCAAAAG | CUUUUGCUUACCUAUUCCAUC | | [1031-1051](21/21) 3'UTR |
| 459 | GGUUUAUAGUACAGCCUAGAG | CUCUAGGCUGUACUAUAAACC | | [1849-1869](21/21) 3'UTR |
| 460 | GAUUGUGUGUGAUUCUAGCGU | ACGCUAGAAUCACACACAAUC | | [572-592](21/21) ORF |
| 461 | CGGCAAUAAUGGAACUGCUUC | GAAGCAGUUCCAUUAUUGCCG | | [1353-1373](21/21) 3'UTR |
| 462 | CUCCAAAGGUUCACUGUGUUU | AAACACAGUGAACCUUUGGAG | | [2355-2375](21/21) 3'UTR |
| 463 | AGAAGCCACCUGCCUGUGUUU | AAACACAGGCAGGUGGCUUCU | | [93-113](21/21) 5'UTR |
| 464 | UGUCAAGGGUAGUAGCUGUAU | AUACAGCUACUACCCUUGACA | | [1766-1786](21/21) 3'UTR |
| 465 | CAUUGAGUGAAUGAUGAAUAC | GUAUUCAUCAUUCACUCAAUG | | [1573-1593](21/21) 3'UTR |
| 466 | AGGUUUCCUGCCCUAGCUAUU | AAUAGCUAGGGCAGGAAACCU | | [2098-2118](21/21) 3'UTR |
| 467 | UCCUGAACCCAACCUCAACGA | UCGUUGAGGUUGGGUUCAGGA | Chimp | [320-340](21/21) ORF |
| 468 | AGUAGAAGCCCAUUUGAGUUU | AAACUCAAAUGGGCUUCUACU | | [1050-1070](21/21) 3'UTR |
| 469 | GCCUCCACUCAACAAUGUUCA | UGAACAUUGUUGAGUGGAGGC | | [2024-2044](21/21) 3'UTR |
| 470 | GUUAAAAUGCUGGAGAACUGU | ACAGUUCUCCAGCAUUUUAAC | Chimp | [375-395](21/21) ORF |
| 471 | AUACCUGUGAGGAUAGGAAAU | AUUUCCUAUCCUCACAGGUAU | | [1590-1610](21/21) 3'UTR |
| 472 | UGUACAGAAUUGAAUGGGAUG | CAUCCCAUUCAAUUCUGUACA | | [1014-1034](21/21) 3'UTR |
| 473 | CAGUGUUAUCUCAUCUCUGGG | CCCAGAGAUGAGAUAACACUG | | [1707-1727](21/21) 3'UTR |
| 474 | UGGACUAGCUUCAGGGACUUU | AAAGUCCCUGAAGCUAGUCCA | Chimp | [642-662](21/21) ORF |
| 475 | UGUGAGGAUAGGAAAUUAGUU | AACUAAUUUCCUAUCCUCACA | | [1595-1615](21/21) 3'UTR |
| 476 | GAGGCAACAAAAGCUUGUGGU | ACCACAAGCUUUUGUUGCCUC | | [1412-1432](21/21) 3'UTR |
| 477 | UCUGGCCUUUGGAGAAGUGAU | AUCACUUCUCCAAAGGCCAGA | | [956-976](21/21) 3'UTR |
| 478 | CAUCUCUGGGCUUUUCUGGGA | UCCCAGAAAAGCCCAGAGAUG | | [1718-1738](21/21) 3'UTR |
| 479 | GAGAAUGAAACUCACCGUCCA | UGGACGGUGAGUUUCAUUCUC | | [1867-1887](21/21) 3'UTR |
| 480 | UUUAUAGUACAGCCUAGAGAA | UUCUCUAGGCUGUACUAUAAA | | [1851-1871](21/21) 3'UTR |
| 481 | AGAACUGUUGUCCUUUUUCCA | UGGAAAAAGGACAACAGUUCU | | [2434-2454](21/21) 3'UTR |
| 482 | AACUAAACUGGUUGCUCAAA | UUUGAGCAACCAAGUUUAGUU | Chimp | [413-433](21/21) ORF |
| 483 | GUGACUUCCUCACUCUAAUGU | ACAUUAGAGUGAGGAAGUCAC | | [1385-1405](21/21) 3'UTR |
| 484 | ACAAAAGCUUGUGGUGCCAUU | AAUGGCACCACAAGCUUUUGU | | [1418-1438](21/21) 3'UTR |
| 485 | CUGACCCAGAGAAUUGCUCAA | UUGAGCAAUUCUCUGGGUCAG | Chimp, Ms | [453-473](21/21) ORF |
| 486 | UCAGGAUUUCGACUUGUUAAG | CUUAACAAGUCGAAAUCCUGA | | [717-737](21/21) ORF |
| 487 | ACUCUUCCAUUGAGUGAAUGA | UCAUUCACUCAAUGGAAGAGU | | [1566-1586](21/21) 3'UTR |
| 488 | GCUAAAGUCAUUUGUAGUUUG | CAAACUACAAAUGACUUUAGC | | [845-865](21/21) 3'UTR |
| 489 | CAUUGGCUAUGGAGAUAUGGU | ACCAUAUCUCCAUAGCCAAUG | | [1831-1851](21/21) 3'UTR |
| 490 | GAACUGCUCAUGGACUAGCUU | AAGCUAGUCCAUGAGCAGUUC | Dog, Chimp | [632-652](21/21) ORF |
| 491 | CUUGGUUGCUCAAAGGUCCUU | AAGGACCUUUGAGCAACCAAG | Chimp | [420-440](21/21) ORF |
| 492 | GAUACCUGUCACUAGGGAAUA | UAUUCCCUAGUGACAGGUAUC | | [1924-1944](21/21) 3'UTR |
| 493 | AAGGUCCUUGUCCCUGAGAAA | UUUCUCAGGGACAAGGACCUU | Chimp | [432-452](21/21) ORF |
| 494 | GGCAGUUUGAGCAGCAAGAAC | GUUCUUGCUGCUCAAACUGCC | Chimp | [216-236](21/21) ORF |

TABLE C-continued

21 mers

| Number | Sense siRNA | AntiSense siRNA | Other Sp | Hum-34222182 ORF: 204-785 |
|---|---|---|---|---|
| 495 | CUGGCCUUUGGAGAAGUGAUU | AAUCACUUCUCCAAAGGCCAG | | [957-977](21/21) 3'UTR |
| 496 | AUUGGAACAACAGUGAUUGAA | UUCAAUCACUGUUGUUCCAAU | | [756-776](21/21) ORF |
| 497 | GAUGUAUUCAUCCUGGUGUUA | UAACACCAGGAUGAAUACAUC | | [2156-2176](21/21) 3'UTR |
| 498 | CCGUUGACCAUGGUUGCAACU | AGUUGCAACCAUGGUCAACGG | Chimp | [195-215](21/21) 5'UTR + ORF |
| 499 | CUAUAUAAACCAGAUUUGCCU | AGGCAAAUCUGGUUUAUAUAG | | [1116-1136](21/21) 3'UTR |
| 500 | GAUGUAGAACUGUUGUCCUUU | AAAGGACAACAGUUCUACAUC | | [2429-2449](21/21) 3'UTR |

TABLE D

23 mers

| Number | Sense siRNA | AntiSense siRNA | Other Sp | Hum-34222182 ORF: 204-785 |
|---|---|---|---|---|
| 1 | GAGUUUUACAUUUGAUUCCACAA | UUGUGGAAUCAAAUGUAAAACUC | | [1065-1087](23/23) 3'UTR |
| 2 | GGUAAUAGACUAUAUAAACCAGA | UCUGGUUUAUAUAGUCUAUUACC | | [1107-1129](23/23) 3'UTR |
| 3 | GGGAAUUGAAGUAUCUCUCCUUA | UAAGGAGAGAUACUUCAAUUCCC | | [1735-1757](23/23) 3'UTR |
| 4 | GAAAAUGUAUGUAAAAGCUGGA | UCCAGCUUUUUACAUACAUUUUC | Chimp, Ms | [546-568](23/23) ORF |
| 5 | CAGAGGAUUUUUAAAUCACAGA | UCUGUGAUUUAAAAAUCCUCUG | | [1175-1197](23/23) 3'UTR |
| 6 | GGCUGUUAAAUUAAUAUUCCUGU | ACAGGAAUAUUAAUUUAACAGCC | | [2516-2538](23/23) 3'UTR |
| 7 | GCCUUAUUUUUGUCUUAUUCCA | UGGAAUAAGACAAAAAUAAGGC | | [1951-1973](23/23) 3'UTR |
| 8 | CAAAUUUGAAGGGUUUUUAGACA | UGUCUAAAAACCCUUCAAAUUUG | | [1261-1283](23/23) 3'UTR |
| 9 | CUAAGUGAUUUGACUACUGGGA | UCCCAGUAGUCAAAUCACUUAG | Chimp | [288-310](23/23) ORF |
| 10 | CUAUCACCCAGAGAGCCUGCUAA | UUAGCAGGCUCUCUGGGUGAUAG | Chimp | [269-291](23/23) ORF |
| 11 | AGAUGUCCUGCGGCUUUCCUCAA | UUGAGGAAAGCCGCAGGACAUCU | Chimp | [473-495](23/23) ORF |
| 12 | AACUAUUCAGCUAGUCAGCUAAA | UUUAGCUGACUAGCUGAAUAGUU | | [828-850](23/23) 3'UTR |
| 13 | GUUGUUUUGCAUGUCUAUUGUUA | UAACAAUAGACAUGCAAAACAAC | | [2330-2352](23/23) 3'UTR |
| 14 | UGAGUUUUACAUUUGAUUCCACA | UGUGGAAUCAAAUGUAAAACUCA | | [1064-1086](23/23) 3'UTR |
| 15 | GGUAGUAAAACUAUUCAGCUAGU | ACUAGCUGAAUAGUUUUACUACC | | [820-842](23/23) 3'UTR |
| 16 | AGUAUUACAUGUGCUUAAUCUCA | UGAGAUUAAGCACAUGUAAUACU | | [1664-1686](23/23) 3'UTR |
| 17 | CUGUUAUGCUUACAAAAUGGUGA | UCACCAUUUUGUAAGCAUAACAG | | [2481-2503](23/23) 3'UTR |
| 18 | UCUCUUGCCUGUUAUGCUUACAA | UUGUAAGCAUAACAGGCAAGAGA | | [2473-2495](23/23) 3'UTR |
| 19 | CCAUUUCACCAUGGCAGUGUUAU | AUAACACUGCCAUGGUGAAAUGG | | [1693-1715](23/23) 3'UTR |
| 20 | UGAUCCUCAGCUCAGGAUUUCGA | UCGAAAUCCUGAGCUGAGGAUCA | | [706-728](23/23) ORF |
| 21 | CAAAAUAGUGUAGAUUUUCUGCA | UGCAGAAAAUCUACACUAUUUUG | | [978-1000](23/23) 3'UTR |
| 22 | GGUUAAAAUGCUGGAGAACUGUC | GACAGUUCUCCAGCAUUUUAACC | Chimp | [374-396](23/23) ORF |
| 23 | CUGAUAUUUUGUGUGUAGUUGA | UCAACUACACACAAAAAUAUCAG | | [1541-1563](23/23) 3'UTR |
| 24 | GUAGGUGAGUUUAAUUAAAGCUU | AAGCUUUAAUUAAACUCACCUAC | | [1299-1321](23/23) 3'UTR |
| 25 | ACAAACUAAACUCUUCAAAUGCU | AGCAUUUGAAGAGUUUAGUUUGU | | [2254-2276](23/23) 3'UTR |
| 26 | CCUACUUUUGAGCUUACACUUGU | ACAAGUGUAAGCUCAAAAGUAGG | Chimp | [597-619](23/23) ORF |
| 27 | GCCCAUUUGAGUUUUACAUUUGA | UCAAAUGUAAAACUCAAAUGGGC | | [1057-1079](23/23) 3'UTR |

TABLE D-continued

| | | 23 mers | | |
|---|---|---|---|---|
| Number | Sense siRNA | AntiSense siRNA | Other Sp | Hum-34222182 ORF: 204-785 |
| 28 | GAUUACUCUUCCAUUGAGUGAAU | AUUCACUCAAUGGAAGAGUAAUC | | [1562-1584](23/23) 3'UTR |
| 29 | UGUUAUGCUUACAAAAUGGUGAU | AUCACCAUUUUGUAAGCAUAACA | | [2482-2504](23/23) 3'UTR |
| 30 | AGUUGUCACCACUGACUGGGCAA | UUGCCCAGUCAGUGGUGACAACU | | [2391-2413](23/23) 3'UTR |
| 31 | CUCAAAUUUGAAGGGUUUUUAGA | UCUAAAACCCUUCAAAUUUGAG | | [1259-1281](23/23) 3'UTR |
| 32 | GCUUCUCCUCUGGUUUCAGGAGA | UCUCCUGAAACCAGAGGAGAAGC | | [679-701](23/23) ORF |
| 33 | GCAACUGCAGCUAACAGGCUGAU | AUCAGCCUGUUAGCUGCAGUUGC | | [931-953](23/23) 3'UTR |
| 34 | GACAGAUGUAUUCAUCCUGGUGU | ACACCAGGAUGAAUACAUCUGUC | | [2152-2174](23/23) 3'UTR |
| 35 | GAACUGCUCAUGGACUAGCUUCA | UGAAGCUAGUCCAUGAGCAGUUC | Dog, Chimp | [632-654](23/23) ORF |
| 36 | UAUUUAGCCUAUCAAACUUCCA | UGGAAGUUUUGAUAGGCUAAAUA | | [1212-1234](23/23) 3'UTR |
| 37 | CCCAUUUGAGUUUUACAUUUGAU | AUCAAAUGUAAAACUCAAAUGGG | | [1058-1080](23/23) 3'UTR |
| 38 | CUAAGAAGCCACCUGCCUGUGUU | AACACAGGCAGGUGGCUUCUUAG | | [90-112](23/23) 5'UTR |
| 39 | CUAUCAAAACUUCCAAAAGCCCA | UGGGCUUUUGGAAGUUUUGAUAG | | [1220-1242](23/23) 3'UTR |
| 40 | UGAUUACUCUUCCAUUGAGUGAA | UUCACUCAAUGGAAGAGUAAUCA | | [1561-1583](23/23) 3'UTR |
| 41 | UAAUUAAAGCUUACCCUAGGUA | UACCUAGGGUUAAGCUUUAAUUA | | [1310-1332](23/23) 3'UTR |
| 42 | CCCUAGCUAUUAGCUCCACUUCA | UGAAGUGGAGCUAAUAGCUAGGG | | [2108-2130](23/23) 3'UTR |
| 43 | GGGACAGAUGUAUUCAUCCUGGU | ACCAGGAUGAAUACAUCUGUCCC | | [2150-2172](23/23) 3'UTR |
| 44 | UGAACCCAACCUCAACGAGGUAA | UUACCUCGUUGAGGUUGGGUUCA | Chimp | [323-345](23/23) ORF |
| 45 | AGGUAAGCAAAAGUAGAAGCCCA | UGGGCUUCUACUUUUGCUUACCU | | [1039-1061](23/23) 3'UTR |
| 46 | ACAAUUUGGUUUCAGGUAGGCUU | AAGCCUACCUGAAACCAAAUUGU | | [1084-1106](23/23) 3'UTR |
| 47 | GACUCUCUUGCCUGUUAUGCUUA | UAAGCAUAACAGGCAAGAGAGUC | | [2470-2492](23/23) 3'UTR |
| 48 | GUCUCUUUUCUUUCUGUGUUUCA | UGAAACACAGAAAGAAAAGAGAC | | [900-922](23/23) 3'UTR |
| 49 | CUCUGAUCCUCAGCUCAGGAUUU | AAAUCCUGAGCUGAGGAUCAGAG | | [703-725](23/23) ORF |
| 50 | GUUUAAGCAGGAGAACUGCUCAU | AUGAGCAGUUCUCCUGCUUAAAC | Dog, Chimp | [620-642](23/23) ORF |
| 51 | GGUAAGCAAAAGUAGAAGCCCAU | AUGGGCUUCUACUUUUGCUUACC | | [1040-1062](23/23) 3'UTR |
| 52 | GAACUCUGAUCCUCAGCUCAGGA | UCCUGAGCUGAGGAUCAGAGUUC | | [700-722](23/23) ORF |
| 53 | UCUGUGUUUCACAUUCAUAGCAA | UUGCUAUGAAUGUGAAACACAGA | | [912-934](23/23) 3'UTR |
| 54 | UGUUUUGCAUGUCUAUUGUUAAG | CUUAACAAUAGACAUGCAAAACA | | [2332-2354](23/23) 3'UTR |
| 55 | UGAAAAACAGGUGUGAUCCUGUU | AACAGGAUCACACCUGUUUUUCA | | [2178-2200](23/23) 3'UTR |
| 56 | CCUAUUUUGAUUUCAUAUGGCU | AGCCAUAUGAAAAUCAAAAUAGG | | [1134-1156](23/23) 3'UTR |
| 57 | CACUGUUCAAAUUAGCCAGUGUU | AACACUGGCUAAUUUGAACAGUG | | [2228-2250](23/23) 3'UTR |
| 58 | CAAAUGUAGUCUCUUUUCUUUCU | AGAAAGAAAAGAGACUACAUUUG | | [892-914](23/23) 3'UTR |
| 59 | CAGAUAACCAUGCAUGCACCCAG | CUGGGUGCAUGCAUGGUUAUCUG | | [1886-1908](23/23) 3'UTR |
| 60 | GUUGAAUACUGUCUUUAAACUAG | CUAGUUUAAAGACAGUAUUCAAC | | [1499-1521](23/23) 3'UTR |
| 61 | GCAACAAAGCUUGUGGUGCCAU | AUGGCACCACAAGCUUUUGUUGC | | [1415-1437](23/23) 3'UTR |
| 62 | GAUAUGGUUUAUAGUACAGCCUA | UAGGCUGUACUAUAAACCAUAUC | | [1844-1866](23/23) 3'UTR |
| 63 | GACUAUAUAAACCAGAUUUGCCU | AGGCAAAUCUGGUUUAUAUAGUC | | [1114-1136](23/23) 3'UTR |
| 64 | CUUAUUCCAACUAAGUAGAUCAU | AUGAUCUACUUAGUUGGAAUAAG | | [1965-1987](23/23) 3'UTR |

TABLE D-continued 23 mers

| Number | Sense siRNA | AntiSense siRNA | Other Sp | Hum-34222182 ORF: 204-785 |
|---|---|---|---|---|
| 65 | GUAUUACAUGUGCUUAAUCUCAG | CUGAGAUUAAGCACAUGUAAUAC | | [1665-1687](23/23) 3'UTR |
| 66 | AGUAAAACUAUUCAGCUAGUCAG | CUGACUAGCUGAAUAGUUUUACU | | [823-845](23/23) 3'UTR |
| 67 | CUCUCUUGCCUGUUAUGCUUACA | UGUAAGCAUAACAGGCAAGAGAG | | [2472-2494](23/23) 3'UTR |
| 68 | AGAUUAUUUCAUGAUUGGGUAGU | ACUACCCAAUCAUGAAAUAAUCU | | [803-825](23/23) 3'UTR |
| 69 | GUUAAAAUGCUGGAGAACUGUCU | AGACAGUUCUCCAGCAUUUUAAC | Chimp | [375-397](23/23) ORF |
| 70 | AAACUAUUCAGCUAGUCAGCUAA | UUAGCUGACUAGCUGAAUAGUUU | | [827-849](23/23) 3'UTR |
| 71 | GAAAAACAGGUGUGAUCCUGUUA | UAACAGGAUCACACCUGUUUUUC | | [2179-2201](23/23) 3'UTR |
| 72 | GCUUCACUGUUUCUUGGUGACUU | AAGUCACCAAGAAACAGUGAAGC | | [1369-1391](23/23) 3'UTR |
| 73 | AGAACCCGGCCAGCAUUUCAGAA | UUCUGAAAUGCUGGCCGGGUUCU | Chimp | [232-254](23/23) ORF |
| 74 | UAGCCUCCACUCAACAAUGUUCA | UGAACAUUGUUGAGUGGAGGCUA | | [2022-2044](23/23) 3'UTR |
| 75 | UGAACUGAUAUUUUGUGUGUAG | CUACACACAAAAAUAUCAGUUCA | | [1537-1559](23/23) 3'UTR |
| 76 | AGUAAUCUAUCCUCUUUUCAGUA | UACUGAAAAGAGGAUAGAUUACU | | [1645-1667](23/23) 3'UTR |
| 77 | GGUGAGUUUAAUUAAAGCUUAAC | GUUAAGCUUUAAUUAAACUCACC | | [1302-1324](23/23) 3'UTR |
| 78 | UGUUCAAUUCAGCAAGGCUUUCA | UGAAAGCCUUGCUGAAUUGAACA | | [2039-2061](23/23) 3'UTR |
| 79 | GUAAUCUAUCCUCUUUUCAGUAU | AUACUGAAAAGAGGAUAGAUUAC | | [1646-1668](23/23) 3'UTR |
| 80 | UCUUUCUGUGUUUCACAUUCAUA | UAUGAAUGUGAAACACAGAAAGA | | [908-930](23/23) 3'UTR |
| 81 | AGUAGGUGAGUUUAAUUAAAGCU | AGCUUUAAUUAAACUCACCUACU | | [1298-1320](23/23) 3'UTR |
| 82 | GAAAUUAGUUCUGAGAUCUAGUC | GACUAGAUCUCAGAACUAAUUUC | | [1606-1628](23/23) 3'UTR |
| 83 | UCACUAGGGAAUAAUAAGGCCU | AGGCCUUAUUAUUCCCUAGUGA | | [1932-1954](23/23) 3'UTR |
| 84 | AAACUCACCGUCCAGAUAACCAU | AUGGUUAUCUGGACGGUGAGUUU | | [1874-1896](23/23) 3'UTR |
| 85 | ACUGUUUCUUGGUGACUUCCUCA | UGAGGAAGUCACCAAGAAACAGU | | [1374-1396](23/23) 3'UTR |
| 86 | GUGUUAUCUCAUCUCUGGGCUUU | AAAGCCCAGAGAUGAGAUAACAC | | [1709-1731](23/23) 3'UTR |
| 87 | ACUAUAAGUGACCUAAAAUGUCA | UGACAUUUUAGGUCACUAUAGU | | [2207-2229](23/23) 3'UTR |
| 88 | UUAGCUCCACUUCACAUGCUGGA | UCCAGCAUGUGAAGUGGAGCUAA | | [2117-2139](23/23) 3'UTR |
| 89 | AAUGUCACUGUUCAAAUUAGCCA | UGGCUAAUUUGAACAGUGACAUU | | [2223-2245](23/23) 3'UTR |
| 90 | UGGGAAUUGAAGUAUCUCUCCUU | AAGGAGAGAUACUUCAAUUCCCA | | [1734-1756](23/23) 3'UTR |
| 91 | AAAACUAUUCAGCUAGUCAGCUA | UAGCUGACUAGCUGAAUAGUUUU | | [826-848](23/23) 3'UTR |
| 92 | CCACUCAACAAUGUUCAAUUCAG | CUGAAUUGAACAUUGUUGAGUGG | | [2028-2050](23/23) 3'UTR |
| 93 | CAUAUGGCUUUUUUUCUCUAAG | CUUAGAGAAAAAAAGCCAUAUG | | [1148-1170](23/23) 3'UTR |
| 94 | AAGCUUAACCCUAGGUAAGAGUA | UACUCUUACCUAGGGUUAAGCUU | | [1316-1338](23/23) 3'UTR |
| 95 | GAAUUGCUGGACUGUGGCUAUCA | UGAUAGCCACAGUCCAGCAAUUC | Chimp | [252-274](23/23) ORF |
| 96 | GCUAAGUGAUUUUGACUACUGGG | CCCAGUAGUCAAAAUCACUUAGC | Chimp | [287-309](23/23) ORF |
| 97 | AAACAGGUGUGAUCCUGUUACU | AGUAACAGGAUCACACCUGUUUU | | [2181-2203](23/23) 3'UTR |
| 98 | UGCUCAAGAUGUCCUGCGGCUUU | AAAGCCGCAGGACAUCUUGAGCA | Chimp | [467-489](23/23) ORF |
| 99 | GUGUUACUGAAAAACAGGUGUGA | UCACACCUGUUUUUCAGUAACAC | | [2171-2193](23/23) 3'UTR |
| 100 | AACUCUGAUCCUCAGCUCAGGAU | AUCCUGAGCUGAGGAUCAGAGUU | | [701-723](23/23) ORF |
| 101 | ACAGAUGUAUUCAUCCUGGUGUU | AACACCAGGAUGAAUACAUCUGU | | [2153-2175](23/23) 3'UTR |

TABLE D-continued 23 mers

| Number | Sense siRNA | AntiSense siRNA | Other Sp | Hum-34222182 ORF: 204-785 |
|---|---|---|---|---|
| 102 | UGUUUAAGCAGGAGAACUGCUCA | UGAGCAGUUCUCCUGCUUAAACA | Dog, Chimp | [619-641](23/23) ORF |
| 103 | ACUGCUUCACUGUUUCUUGGUGA | UCACCAAGAAACAGUGAAGCAGU | | [1366-1388](23/23) 3'UTR |
| 104 | AAGAAGCCACCUGCCUGUGUUUA | UAAACACAGGCAGGUGGCUUCUU | | [92-114](23/23) 5'UTR |
| 105 | CCACUUUGAAUUAUUGAAACGGG | CCCGUUUCAAUAAUUCAAAGUGG | | [1791-1813](23/23) 3'UTR |
| 106 | UCAAGAUGUCCUGCGGCUUUCCU | AGGAAAGCCGCAGGACAUCUUGA | Chimp | [470-492](23/23) ORF |
| 107 | GAGAUAUGGUUUAUAGUACAGCC | GGCUGUACUAUAAACCAUAUCUC | | [1842-1864](23/23) 3'UTR |
| 108 | UACACUUGUGUUUAAGCAGGAGA | UCUCCUGCUUAAACACAAGUGUA | Chimp | [611-633](23/23) ORF |
| 109 | GAUUCACUUAGUAAUCUAUCCUC | GAGGAUAGAUUACUAAGUGAAUC | | [1636-1658](23/23) 3'UTR |
| 110 | GGUGCCAUUUCAGUAACCACGGU | ACCGUGGUUACUGAAAUGGCACC | | [1430-1452](23/23) 3'UTR |
| 111 | AAUCAAUGUUGUUUGCAUGUCU | AGACAUGCAAAACAACAUUGAUU | | [2323-2345](23/23) 3'UTR |
| 112 | AAUAAUGGAACUGCUUCACUGUU | AACAGUGAAGCAGUUCCAUUAUU | | [1357-1379](23/23) 3'UTR |
| 113 | UAUCCUUGCUGUGGGUCGUGGAU | AUCCACGACCCACAGCAAGGAUA | | [2062-2084](23/23) 3'UTR |
| 114 | GAUUCCACAAUUUGGUUUCAGGU | ACCUGAAACCAAAUUGUGGAAUC | | [1078-1100](23/23) 3'UTR |
| 115 | UAGUAAAACUAUUCAGCUAGUCA | UGACUAGCUGAAUAGUUUUACUA | | [822-844](23/23) 3'UTR |
| 116 | ACAUUUGAUUCCACAAUUUGGUU | AACCAAAUUGUGGAAUCAAAUGU | | [1072-1094](23/23) 3'UTR |
| 117 | CAAGGCUUUCAUAUCCUUGCUGU | ACAGCAAGGAUAUGAAAGCCUUG | | [2051-2073](23/23) 3'UTR |
| 118 | GAAGUGAUUCAAAAUAGUGUAGA | UCUACACUAUUUUGAAUCACUUC | | [969-991](23/23) 3'UTR |
| 119 | UGUGUUUCACAUUCAUAGCAACU | AGUUGCUAUGAAUGUGAAACACA | | [914-936](23/23) 3'UTR |
| 120 | GUUUCACAUUCAUAGCAACUGCA | UGCAGUUGCUAUGAAUGUGAAAC | | [917-939](23/23) 3'UTR |
| 121 | CUCAUCUCUGGGCUUUUCUGGGA | UCCCAGAAAAGCCCAGAGAUGAG | | [1716-1738](23/23) 3'UTR |
| 122 | UCUUAUUCCAACUAAGUAGAUCA | UGAUCUACUUAGUUGGAAUAAGA | | [1964-1986](23/23) 3'UTR |
| 123 | GUUUAAUUAAAGCUUAACCCUAG | CUAGGGUUAAGCUUUAAUUAAAC | | [1307-1329](23/23) 3'UTR |
| 124 | ACAUUCAUAGCAACUGCAGCUAA | UUAGCUGCAGUUGCUAUGAAUGU | | [922-944](23/23) 3'UTR |
| 125 | UUGAUUACUCUUCCAUUGAGUGA | UCACUCAAUGGAAGAGUAAUCAA | | [1560-1582](23/23) 3'UTR |
| 126 | GCUUGCGAGGUUGUGUUAUGCAC | GUGCAUAACACAACCUCGCAAGC | | [508-530](23/23) ORF |
| 127 | AGAAGCCACCUGCCUGUGUUUAC | GUAAACACAGGCAGGUGGCUUCU | | [93-115](23/23) 5'UTR |
| 128 | AAUGUAGUCUCUUUUCUUUCUGU | ACAGAAAGAAAAGAGACUACAUU | | [894-916](23/23) 3'UTR |
| 129 | UAAGAAGCCACCUGCCUGUGUUU | AAACACAGGCAGGUGGCUUCUUA | | [91-113](23/23) 5'UTR |
| 130 | AGAACUGCUCAUGGACUAGCUUC | GAAGCUAGUCCAUGAGCAGUUCU | Dog, Chimp | [631-653](23/23) ORF |
| 131 | CUAUAUAAACCAGAUUUGCCUAU | AUAGGCAAAUCUGGUUUAUAUAG | | [1116-1138](23/23) 3'UTR |
| 132 | UGGUAAUAGACUAUAUAAACCAG | CUGGUUUAUAUAGUCUAUUACCA | | [1106-1128](23/23) 3'UTR |
| 133 | GCCAAGAUAAAUCAAUGUUGUUU | AAACAACAUUGAUUUAUCUUGGC | | [2314-2336](23/23) 3'UTR |
| 134 | UCAGAGGAUUUUUAAAAUCACAG | CUGUGAUUUUAAAAAUCCUCUGA | | [1174-1196](23/23) 3'UTR |
| 135 | GAUAUUUAGCCUAUCAAAACUUC | GAAGUUUUGAUAGGCUAAAUAUC | | [1210-1232](23/23) 3'UTR |
| 136 | GAGAACUCUGAUCCUCAGCUCAG | CUGAGCUGAGGAUCAGAGUUCUC | | [698-720](23/23) ORF |
| 137 | CACUGUUUCUUGGUGACUUCCUC | GAGGAAGUCACCAAGAAACAGUG | | [1373-1395](23/23) 3'UTR |
| 138 | AGUAAAUGAGAAAUAUUACGGCA | UGCCGUAAUAUUUCUCAUUUACU | | [1335-1357](23/23) 3'UTR |

TABLE D-continued 23 mers

| Number | Sense siRNA | AntiSense siRNA | Other Sp | Hum-34222182 ORF: 204-785 |
|---|---|---|---|---|
| 139 | ACUAUAUAAACCAGAUUUGCCUA | UAGGCAAAUCUGGUUUAUAUAGU | | [1115-1137](23/23) 3'UTR |
| 140 | CAAUUUGGUUUCAGGUAGGCUUG | CAAGCCUACCUGAAACCAAAUUG | | [1085-1107](23/23) 3'UTR |
| 141 | CAAAGGUUCACUGUGUUUCUGCC | GGCAGAAACACAGUGAACCUUUG | | [2358-2380](23/23) 3'UTR |
| 142 | CAUUUCACCAUGGCAGUGUUAUC | GAUAACACUGCCAUGGUGAAAUG | | [1694-1716](23/23) 3'UTR |
| 143 | AAAAACUUUACUCACUGAUUGGA | UCCAAUCAGUGAGUAAAGUUUUU | | [739-761](23/23) ORF |
| 144 | UGUAGUCUCUUUUCUUUCUGUGU | ACACAGAAAGAAAAGAGACUACA | | [896-918](23/23) 3'UTR |
| 145 | GGUGUUACUGAAAAACAGGUGUG | CACACCUGUUUUUCAGUAACACC | | [2170-2192](23/23) 3'UTR |
| 146 | CUGUUCUUAAGUGUUGAAUACUG | CAGUAUUCAACACUUAAGAACAG | | [1487-1509](23/23) 3'UTR |
| 147 | GAAAAACUUUACUCACUGAUUG | CAAUCAGUGAGUAAAGUUUUUUC | | [737-759](23/23) ORF |
| 148 | GAACUGAUAUUUUGUGUGUAGU | ACUACACACAAAAAUAUCAGUUC | | [1538-1560](23/23) 3'UTR |
| 149 | CAUCGAUGUAGAACUGUUGUCCU | AGGACAACAGUUCUACAUCGAUG | | [2425-2447](23/23) 3'UTR |
| 150 | CUUGGUUGCUCAAAGGUCCUUGU | ACAAGGACCUUUGAGCAACCAAG | Chimp | [420-442](23/23) ORF |
| 151 | CAACUAAGUAGAUCAUUAUCUCU | AGAGAUAAUGAUCUACUUAGUUG | | [1972-1994](23/23) 3'UTR |
| 152 | UAAAAUGCUGGAGAACUGUCUGU | ACAGACAGUUCUCCAGCAUUUUA | Dog, Chimp | [377-399](23/23) ORF |
| 153 | GAUAAGGAGCUUAUUCAGGUUUC | GAAACCUGAAUAAGCUCCUUAUC | | [2082-2104](23/23) 3'UTR |
| 154 | AAACAGAGCCGUUGACCAUGGUU | AACCAUGGUCAACGGCUCUGUUU | Chimp, Rat, Ms | [187-209](23/23) 5'UTR + ORF |
| 155 | CUGCUAAGUGAUUUUGACUACUG | CAGUAGUCAAAAUCACUUAGCAG | Chimp | [285-307](23/23) ORF |
| 156 | CCUCACUCUAAUGUUUUAAAGAG | CUCUUUAAAACAUUAGAGUGAGG | | [1392-1414](23/23) 3'UTR |
| 157 | UUUUGAGCUUACACUUGUGUUUA | UAAACACAAGUGUAAGCUCAAAA | Chimp | [602-624](23/23) ORF |
| 158 | CUGAAAACAGGUGUGAUCCUGU | ACAGGAUCACACCUGUUUUUCAG | | [2177-2199](23/23) 3'UTR |
| 159 | UGCUUACAAAAUGGUGAUGGCUU | AAGCCAUCACCAUUUUGUAAGCA | | [2487-2509](23/23) 3'UTR |
| 160 | GUGAGUUUAAUUAAAGCUUAACC | GGUUAAGCUUUAAUUAAACUCAC | | [1303-1325](23/23) 3'UTR |
| 161 | GUGAUGGCUUAUGGAAGGCUGUU | AACAGCCUUCCAUAAGCCAUCAC | | [2500-2522](23/23) 3'UTR |
| 162 | CACUUUGAAUUAUUGAAACGGGU | ACCCGUUUCAAUAAUUCAAAGUG | | [1792-1814](23/23) 3'UTR |
| 163 | GUUCACUGUGUUUCUGCCGCUGU | ACAGCGGCAGAAACACAGUGAAC | | [2363-2385](23/23) 3'UTR |
| 164 | AAGAACCCGGCCAGCAUUUCAGA | UCUGAAAUGCUGGCCGGGUUCUU | Chimp, Ms | [231-253](23/23) ORF |
| 165 | UACUCUUCCAUUGAGUGAAUGAU | AUCAUUCACUCAAUGGAAGAGUA | | [1565-1587](23/23) 3'UTR |
| 166 | CUUGUCCCUGAGAAACUGACCCA | UGGGUCAGUUUCUCAGGGACAAG | Dog, Chimp | [438-460](23/23) ORF |
| 167 | AAGAUGUCCUGCGGCUUUCCUCA | UGAGGAAAGCCGCAGGACAUCUU | Chimp | [472-494](23/23) ORF |
| 168 | UAGUCUCUUUUCUUUCUGUGUUU | AAACACAGAAAGAAAAGAGACUA | | [898-920](23/23) 3'UTR |
| 169 | GUGUUGAAUACGUCUUUAAACU | AGUUUAAAGACGUAUUCAACAC | | [1497-1519](23/23) 3'UTR |
| 170 | AGCAACUGCAGCUAACAGGCUGA | UCAGCCUGUUAGCUGCAGUUGCU | | [930-952](23/23) 3'UTR |
| 171 | UGAAAUGUAUGUAAAAGCUGG | CCAGCUUUUUACAUACAUUUUCA | Chimp, Ms | [545-567](23/23) ORF |
| 172 | CUCUUUUCUUUCUGUGUUUCACA | UGUGAAACACAGAAAGAAAAGAG | | [902-924](23/23) 3'UTR |
| 173 | UGCCCUAGCUAUUAGCUCCACUU | AAGUGGAGCUAAUAGCUAGGGCA | | [2106-2128](23/23) 3'UTR |
| 174 | AGCAAACUAAACUUGGUUGCUCA | UGAGCAACCAAGUUUAGUUUGCU | Chimp | [409-431](23/23) ORF |
| 175 | CUAUUCAGCUAGUCAGCUAAAGU | ACUUUAGCUGACUAGCUGAAUAG | | [830-852](23/23) 3'UTR |

TABLE D-continued

23 mers

| Number | Sense siRNA | AntiSense siRNA | Other Sp | Hum-34222182 ORF: 204-785 |
|---|---|---|---|---|
| 176 | UAGAGGUCGCUUCUCCUCUGGUU | AACCAGAGGAGAAGCGACCUCUA | | [671-693](23/23) ORF |
| 177 | AAAAGCCCACACCACCAGUUCCU | AGGAACUGGUGGUGUGGGCUUUU | | [1234-1256](23/23) 3'UTR |
| 178 | GUCCUUGUCCCUGAGAAACUGAC | GUCAGUUUCUCAGGGACAAGGAC | Dog, Chimp | [435-457](23/23) ORF |
| 179 | GAACUGCUUCACUGUUUCUUGGU | ACCAAGAAACAGUGAAGCAGUUC | | [1364-1386](23/23) 3'UTR |
| 180 | AACAGAGCCGUUGACCAUGGUUG | CAACCAUGGUCAACGGCUCUGUU | Chimp, Rat, Ms | [188-210](23/23) 5'UTR + ORF |
| 181 | UGUGUAGUUGAUUACUCUUCCAU | AUGGAAGAGUAAUCAACUACACA | | [1553-1575](23/23) 3'UTR |
| 182 | CUGAACCCAACCUCAACGAGGUA | UACCUCGUUGAGGUUGGGUUCAG | Chimp | [322-344](23/23) ORF |
| 183 | UUUCUGGGAAUUGAAGUAUCUCU | AGAGAUACUUCAAUUCCCAGAAA | | [1730-1752](23/23) 3'UTR |
| 184 | GCUUUCAUAUCCUUGCUGUGGGU | ACCCACAGCAAGGAUAUGAAAGC | | [2055-2077](23/23) 3'UTR |
| 185 | UCUGAUUCACUUAGUAAUCUAUC | GAUAGAUUACUAAGUGAAUCAGA | | [1633-1655](23/23) 3'UTR |
| 186 | CAUUUCAGUAACCACGGUGUUGU | ACAACACCGUGGUUACUGAAAUG | | [1435-1457](23/23) 3'UTR |
| 187 | AAUGUUCAAUUCAGCAAGGCUUU | AAAGCCUUGCUGAAUUGAACAUU | | [2037-2059](23/23) 3'UTR |
| 188 | AGCUCCACUUCACAUGCUGGAGA | UCUCCAGCAUGUGAAGUGGAGCU | | [2119-2141](23/23) 3'UTR |
| 189 | AAACUGACCCAGAGAAUUGCUCA | UGAGCAAUUCUCUGGGUCAGUUU | Chimp, Ms | [450-472](23/23) ORF |
| 190 | CUUACACUUGUGUUUAAGCAGGA | UCCUGCUUAAACACAAGUGUAAG | Chimp | [609-631](23/23) ORF |
| 191 | UAAGCUCCAAAGGUUCACUGUGU | ACACAGUGAACCUUUGGAGCUUA | | [2351-2373](23/23) 3'UTR |
| 192 | ACUUUGAGCUUACACUUGUGUUU | AACACAAGUGUAAGCUCAAAAGU | Chimp | [600-622](23/23) ORF |
| 193 | UGUUACUGAAAAACAGGUGUGAU | AUCACACCUGUUUUUCAGUAACA | | [2172-2194](23/23) 3'UTR |
| 194 | UUUUUUCCACCUUGGAUACCUGU | ACAGGUAUCCAAGGUGGAAAAAA | | [1910-1932](23/23) 3'UTR |
| 195 | UUACUCUUCCAUUGAGUGAAUGA | UCAUUCACUCAAUGGAAGAGUAA | | [1564-1586](23/23) 3'UTR |

TABLE E additional 23 mers

| Number | Sense siRNA | AntiSense siRNA | Other Sp | Hum-34222182 ORF: 204-785 |
|---|---|---|---|---|
| 1 | CAGUGUUCUAACAAACUAAACUC | GAGUUUAGUUUGUUAGAACACUG | | [2244-2266] 3'UTR |
| 2 | CCAGUGUUCUAACAAACUAAACU | AGUUUAGUUUGUUAGAACACUGG | | [2243-2265] 3'UTR |
| 3 | GCCAGUGUUCUAACAAACUAAAC | GUUUAGUUUGUUAGAACACUGGC | | [2242-2264] 3'UTR |
| 4 | AGCCAGUGUUCUAACAAACUAAA | UUUAGUUUGUUAGAACACUGGCU | | [2241-2263] 3'UTR |
| 5 | UAGCCAGUGUUCUAACAAACUAA | UUAGUUUGUUAGAACACUGGCUA | | [2240-2262] 3'UTR |
| 6 | UUAGCCAGUGUUCUAACAAACUA | UAGUUUGUUAGAACACUGGCUAA | | [2239-2261] 3'UTR |
| 7 | GGAUUAUGUUGUUCCUGAACCCA | UGGGUUCAGGAACAACAUAAUCC | Chimp | [308-330] ORF |
| 8 | GGGAUUAUGUUGUUCCUGAACCC | GGGUUCAGGAACAACAUAAUCCC | Chimp | [307-329] ORF |
| 9 | UGGGAUUAUGUUGUUCCUGAACC | GGUUCAGGAACAACAUAAUCCCA | Chimp | [306-328] ORF |
| 10 | CUGGGAUUAUGUUGUUCCUGAAC | GUUCAGGAACAACAUAAUCCCAG | Chimp | [305-327] ORF |
| 11 | ACUGGGAUUAUGUUGUUCCUGAA | UUCAGGAACAACAUAAUCCCAGU | Chimp | [304-326] ORF |
| 12 | GGCUUUUCUGGGAAUUGAAGUAU | AUACUUCAAUUCCCAGAAAAGCC | | [1726-1748] 3'UTR |

TABLE E-continued additional 23 mers

| Number | Sense siRNA | AntiSense siRNA | Other Sp | Hum-34222182 ORF: 204-785 |
|---|---|---|---|---|
| 13 | GGGCUUUUCUGGGAAUUGAAGUA | UACUUCAAUUCCCAGAAAAGCCC | | [1725-1747] 3'UTR |
| 14 | UGGGCUUUUCUGGGAAUUGAAGU | ACUUCAAUUCCCAGAAAAGCCCA | | [1724-1746] 3'UTR |
| 15 | CUGGGCUUUUCUGGGAAUUGAAG | CUUCAAUUCCCAGAAAAGCCCAG | | [1723-1745] 3'UTR |
| 16 | UCUGGGCUUUUCUGGGAAUUGAA | UUCAAUUCCCAGAAAAGCCCAGA | | [1722-1744] 3'UTR |
| 17 | GAUGGAAUAGGUAAGCAAAAGUA | UACUUUGCUUACCUAUUCCAUC | | [1031-1053] 3'UTR |
| 18 | GGAUGGAAUAGGUAAGCAAAAGU | ACUUUGCUUACCUAUUCCAUCC | | [1030-1052] 3'UTR |
| 19 | GGGAUGGAAUAGGUAAGCAAAAG | CUUUGCUUACCUAUUCCAUCCC | | [1029-1051] 3'UTR |
| 20 | UGGGAUGGAAUAGGUAAGCAAAA | UUUGCUUACCUAUUCCAUCCCA | | [1028-1050] 3'UTR |
| 21 | AUGGGAUGGAAUAGGUAAGCAAA | UUUGCUUACCUAUUCCAUCCCAU | | [1027-1049] 3'UTR |
| 22 | CGUGAACUUGGAAAUUGAAAAUG | CAUUUUCAAUUUCCAAGUUCACG | Dog, Chin, GP, Rat | [530-552] ORF |
| 23 | ACGUGAACUUGGAAAUUGAAAAU | AUUUUCAAUUUCCAAGUUCACGU | Dog, Chin, GP, Rat | [529-551] ORF |
| 24 | CACGUGAACUUGGAAAUUGAAAA | UUUUCAAUUUCCAAGUUCACGUG | Dog, Chin, GP, Rat | [528-550] ORF |
| 25 | GCACGUGAACUUGGAAAUUGAAA | UUUCAAUUUCCAAGUUCACGUGC | Dog, Chin, GP, Rat | [527-549] ORF |
| 26 | UGCACGUGAACUUGGAAAUUGAA | UUCAAUUUCCAAGUUCACGUGCA | Dog, Chin, GP, Rat | [526-548] ORF |
| 27 | AAUGGGAUGGAAUAGGUAAGCAA | UUGCUUACCUAUUCCAUCCCAUU | | [1026-1048] 3'UTR |
| 28 | AUUAGCCAGUGUUCUAACAAACU | AGUUUGUUAGAACACUGGCUAAU | | [2238-2260] 3'UTR |
| 29 | AAUUAGCCAGUGUUCUAACAAAC | GUUUGUUAGAACACUGGCUAAUU | | [2237-2259] 3'UTR |
| 30 | AAAUUAGCCAGUGUUCUAACAAA | UUUGUUAGAACACUGGCUAAUUU | | [2236-2258] 3'UTR |
| 31 | GAUUGAAGGGUCCUAAAAAGGGA | UCCCUUUUUAGGACCCUUCAAUC | | [770-792] ORF + 3'UTR |
| 32 | UGAUUGAAGGGUCCUAAAAAGGG | CCCUUUUUAGGACCCUUCAAUCA | | [769-791] ORF + 3'UTR |
| 33 | GUGAUUGAAGGGUCCUAAAAAGG | CCUUUUUAGGACCCUUCAAUCAC | | [768-790] ORF + 3'UTR |
| 34 | AGUGAUUGAAGGGUCCUAAAAAG | CUUUUUAGGACCCUUCAAUCACU | | [767-789] ORF + 3'UTR |
| 35 | CAGUGAUUGAAGGGUCCUAAAAA | UUUUUAGGACCCUUCAAUCACUG | | [766-788] ORF + 3'UTR |
| 36 | GAAUGAUGAAUACCUGUGAGGAU | AUCCUCACAGGUAUUCAUCAUUC | | [1581-1603] 3'UTR |
| 37 | UGAAUGAUGAAUACCUGUGAGGA | UCCUCACAGGUAUUCAUCAUUCA | | [1580-1602] 3'UTR |
| 38 | GUGAAUGAUGAAUACCUGUGAGG | CCUCACAGGUAUUCAUCAUUCAC | | [1579-1601] 3'UTR |
| 39 | AGUGAAUGAUGAAUACCUGUGAG | CUCACAGGUAUUCAUCAUUCACU | | [1578-1600] 3'UTR |
| 40 | GAGUGAAUGAUGAAUACCUGUGA | UCACAGGUAUUCAUCAUUCACUC | | [1577-1599] 3'UTR |
| 41 | CAGAGAGCCUGCUAAGUGAUUUU | AAAAUCACUUAGCAGGCUCUCUG | Chimp | [277-299] ORF |
| 42 | CCAGAGAGCCUGCUAAGUGAUUU | AAAUCACUUAGCAGGCUCUCUGG | Chimp | [276-298] ORF |
| 43 | CCCAGAGAGCCUGCUAAGUGAUU | AAUCACUUAGCAGGCUCUCUGGG | Chimp | [275-297] ORF |
| 44 | ACCCAGAGAGCCUGCUAAGUGAU | AUCACUUAGCAGGCUCUCUGGGU | Chimp | [274-296] ORF |
| 45 | CACCCAGAGAGCCUGCUAAGUGA | UCACUUAGCAGGCUCUCUGGGUG | Chimp | [273-295] ORF |
| 46 | AGAAUUGGGCCAAGAUAAAUCAA | UUGAUUUAUCUUGGCCCAAUUCU | | [2306-2328] 3'UTR |
| 47 | UAGAAUUGGGCCAAGAUAAAUCA | UGAUUUAUCUUGGCCCAAUUCUA | | [2305-2327] 3'UTR |
| 48 | AUAGAAUUGGGCCAAGAUAAAUC | GAUUUAUCUUGGCCCAAUUCUAU | | [2304-2326] 3'UTR |
| 49 | UAUAGAAUUGGGCCAAGAUAAAU | AUUUAUCUUGGCCCAAUUCUAUA | | [2303-2325] 3'UTR |

TABLE E-continued additional 23 mers

| Number | Sense siRNA | AntiSense siRNA | Other Sp | Hum-34222182 ORF: 204-785 |
|---|---|---|---|---|
| 50 | UUAUAGAAUUGGGCCAAGAUAAA | UUUAUCUUGGCCCAAUUCUAUAA | | [2302-2324] 3'UTR |
| 51 | UGCUGUGGGUCGUGGAUAAGGAG | CUCCUUAUCCACGACCCACAGCA | | [2068-2090] 3'UTR |
| 52 | UUGCUGUGGGUCGUGGAUAAGGA | UCCUUAUCCACGACCCACAGCAA | | [2067-2089] 3'UTR |
| 53 | CUUGCUGUGGGUCGUGGAUAAGG | CCUUAUCCACGACCCACAGCAAG | | [2066-2088] 3'UTR |
| 54 | CCUUGCUGUGGGUCGUGGAUAAG | CUUAUCCACGACCCACAGCAAGG | | [2065-2087] 3'UTR |
| 55 | UCCUUGCUGUGGGUCGUGGAUAA | UUAUCCACGACCCACAGCAAGGA | | [2064-2086] 3'UTR |
| 56 | AGGUAAGAGUAAAUGAGAAAUAU | AUAUUUCUCAUUUACUCUUACCU | | [1328-1350] 3'UTR |
| 57 | UAGGUAAGAGUAAAUGAGAAAUA | UAUUUCUCAUUUACUCUUACCUA | | [1327-1349] 3'UTR |
| 58 | CUAGGUAAGAGUAAAUGAGAAAU | AUUUCUCAUUUACUCUUACCUAG | | [1326-1348] 3'UTR |
| 59 | CCUAGGUAAGAGUAAAUGAGAAA | UUUCUCAUUUACUCUUACCUAGG | | [1325-1347] 3'UTR |
| 60 | CCCUAGGUAAGAGUAAAUGAGAA | UUCUCAUUUACUCUUACCUAGGG | | [1324-1346] 3'UTR |
| 61 | CUGUCCAAAUCAAAGCAAACUAA | UUAGUUUGCUUUGAUUUGGACAG | Dog, Chimp | [396-418] ORF |
| 62 | UCUGUCCAAAUCAAAGCAAACUA | UAGUUUGCUUUGAUUUGGACAGA | Dog, Chimp | [395-417] ORF |
| 63 | GUCUGUCCAAAUCAAAGCAAACU | AGUUUGCUUUGAUUUGGACAGAC | Dog, Chimp | [394-416] ORF |
| 64 | UGUCUGUCCAAAUCAAAGCAAAC | GUUUGCUUUGAUUUGGACAGACA | Dog, Chimp | [393-415] ORF |
| 65 | CUGUCUGUCCAAAUCAAAGCAAA | UUUGCUUUGAUUUGGACAGACAG | Dog, Chimp | [392-414] ORF |
| 66 | UCAUGAUUGGGUAGUAAAACUAU | AUAGUUUUACUACCCAAUCAUGA | | [811-833] 3'UTR |
| 67 | UUCAUGAUUGGGUAGUAAAACUA | UAGUUUUACUACCCAAUCAUGAA | | [810-832] 3'UTR |
| 68 | UUUCAUGAUUGGGUAGUAAAACU | AGUUUUACUACCCAAUCAUGAAA | | [809-831] 3'UTR |
| 69 | AUUUCAUGAUUGGGUAGUAAAAC | GUUUUACUACCCAAUCAUGAAAU | | [808-830] 3'UTR |
| 70 | UAUUUCAUGAUUGGGUAGUAAAA | UUUUACUACCCAAUCAUGAAAUA | | [807-829] 3'UTR |
| 71 | ACAGUGAUUGAAGGGUCCUAAAA | UUUUAGGACCCUUCAAUCACUGU | | [765-787] ORF + 3'UTR |
| 72 | AACAGUGAUUGAAGGGUCCUAAA | UUUAGGACCCUUCAAUCACUGUU | | [764-786] ORF + 3'UTR |
| 73 | GGAAGGCUGUUAAAUUAAUAUUC | GAAUAUUAAUUUAACAGCCUUCC | | [2512-2534] 3'UTR |
| 74 | UGGAAGGCUGUUAAAUUAAUAUU | AAUAUUAAUUUAACAGCCUUCCA | | [2511-2533] 3'UTR |
| 75 | AUGGAAGGCUGUUAAAUUAAUAU | AUAUUAAUUUAACAGCCUUCCAU | | [2510-2532] 3'UTR |
| 76 | UAUGGAAGGCUGUUAAAUUAAUA | UAUUAAUUUAACAGCCUUCCAUA | | [2509-2531] 3'UTR |
| 77 | UUAUGGAAGGCUGUUAAAUUAAU | AUUAAUUUAACAGCCUUCCAUAA | | [2508-2530] 3'UTR |
| 78 | CAAGGGUAGUAGCUGUAUACUAC | GUAGUAUACAGCUACUACCCUUG | | [1769-1791] 3'UTR |
| 79 | UCAAGGGUAGUAGCUGUAUACUA | UAGUAUACAGCUACUACCCUUGA | | [1768-1790] 3'UTR |
| 80 | GUCAAGGGUAGUAGCUGUAUACU | AGUAUACAGCUACUACCCUUGAC | | [1767-1789] 3'UTR |
| 81 | UGUCAAGGGUAGUAGCUGUAUAC | GUAUACAGCUACUACCCUUGACA | | [1766-1788] 3'UTR |
| 82 | UUGUCAAGGGUAGUAGCUGUAUA | UAUACAGCUACUACCCUUGACAA | | [1765-1787] 3'UTR |
| 83 | CCAAAUCAAAGCAAACUAAACUU | AAGUUUAGUUUGCUUUGAUUUGG | Chimp | [400-422] ORF |
| 84 | UCCAAAUCAAAGCAAACUAAACU | AGUUUAGUUUGCUUUGAUUUGGA | Chimp | [399-421] ORF |
| 85 | GUCCAAAUCAAAGCAAACUAAAC | GUUUAGUUUGCUUUGAUUUGGAC | Chimp | [398-420] ORF |
| 86 | UGUCCAAAUCAAAGCAAACUAAA | UUUAGUUUGCUUUGAUUUGGACA | Chimp | [397-419] ORF |

TABLE E-continued additional 23 mers

| Number | Sense siRNA | AntiSense siRNA | Other Sp | Hum-34222182 ORF: 204-785 |
|---|---|---|---|---|
| 87 | GCUUAUGGAAGGCUGUUAAAUUA | UAAUUUAACAGCCUUCCAUAAGC | | [2506-2528] 3'UTR |
| 88 | GGCUUAUGGAAGGCUGUUAAAUU | AAUUUAACAGCCUUCCAUAAGCC | | [2505-2527] 3'UTR |
| 89 | UGGCUUAUGGAAGGCUGUUAAAU | AUUUAACAGCCUUCCAUAAGCCA | | [2504-2526] 3'UTR |
| 90 | AUGGCUUAUGGAAGGCUGUUAAA | UUUAACAGCCUUCCAUAAGCCAU | | [2503-2525] 3'UTR |
| 91 | GAUGGCUUAUGGAAGGCUGUUAA | UUAACAGCCUUCCAUAAGCCAUC | | [2502-2524] 3'UTR |
| 92 | UCCUGUUACUGAUACUAUAAGUG | CACUUAUAGUAUCAGUAACAGGA | | [2194-2216] 3'UTR |
| 93 | AUCCUGUUACUGAUACUAUAAGU | ACUUAUAGUAUCAGUAACAGGAU | | [2193-2215] 3'UTR |
| 94 | GAUCCUGUUACUGAUACUAUAAG | CUUAUAGUAUCAGUAACAGGAUC | | [2192-2214] 3'UTR |
| 95 | UGAUCCUGUUACUGAUACUAUAA | UUAUAGUAUCAGUAACAGGAUCA | | [2191-2213] 3'UTR |
| 96 | GUGAUCCUGUUACUGAUACUAUA | UAUAGUAUCAGUAACAGGAUCAC | | [2190-2212] 3'UTR |
| 97 | GGUCCUUGUCCCUGAGAAACUGA | UCAGUUUCUCAGGGACAAGGACC | Chimp | [434-456] ORF |
| 98 | AGGUCCUUGUCCCUGAGAAACUG | CAGUUUCUCAGGGACAAGGACCU | Chimp | [433-455] ORF |
| 99 | AAGGUCCUUGUCCCUGAGAAACU | AGUUUCUCAGGGACAAGGACCUU | Chimp | [432-454] ORF |
| 100 | AAAGGUCCUUGUCCCUGAGAAAC | GUUUCUCAGGGACAAGGACCUUU | Chimp | [431-453] ORF |
| 101 | CAAAGGUCCUUGUCCCUGAGAAA | UUUCUCAGGGACAAGGACCUUUG | Chimp | [430-452] ORF |
| 102 | CCAACUAAGUAGAUCAUUAUCUC | GAGAUAAUGAUCUACUUAGUUGG | | [1971-1993] 3'UTR |
| 103 | UCCAACUAAGUAGAUCAUUAUCU | AGAUAAUGAUCUACUUAGUUGGA | | [1970-1992] 3'UTR |
| 104 | UUCCAACUAAGUAGAUCAUUAUC | GAUAAUGAUCUACUUAGUUGGAA | | [1969-1991] 3'UTR |
| 105 | AUUCCAACUAAGUAGAUCAUUAU | AUAAUGAUCUACUUAGUUGGAAU | | [1968-1990] 3'UTR |
| 106 | UAUUCCAACUAAGUAGAUCAUUA | UAAUGAUCUACUUAGUUGGAAUA | | [1967-1989] 3'UTR |
| 107 | UGGUUAAAAUGCUGGAGAACUGU | ACAGUUCUCCAGCAUUUUAACCA | Chimp | [373-395] ORF |
| 108 | UUGGUUAAAAUGCUGGAGAACUG | CAGUUCUCCAGCAUUUUAACCAA | Chimp | [372-394] ORF |
| 109 | UUUGGUUAAAAUGCUGGAGAACU | AGUUCUCCAGCAUUUUAACCAAA | Chimp | [371-393] ORF |
| 110 | AUUUGGUUAAAAUGCUGGAGAAC | GUUCUCCAGCAUUUUAACCAAAU | Chimp | [370-392] ORF |
| 111 | AAUUUGGUUAAAAUGCUGGAGAA | UUCUCCAGCAUUUUAACCAAAUU | Chimp | [369-391] ORF |
| 112 | CCAUUGAGUGAAUGAUGAAUACC | GGUAUUCAUCAUUCACUCAAUGG | | [1572-1594] 3'UTR |
| 113 | UCCAUUGAGUGAAUGAUGAAUAC | GUAUUCAUCAUUCACUCAAUGGA | | [1571-1593] 3'UTR |
| 114 | UUCCAUUGAGUGAAUGAUGAAUA | UAUUCAUCAUUCACUCAAUGGAA | | [1570-1592] 3'UTR |
| 115 | CUUCCAUUGAGUGAAUGAUGAAU | AUUCAUCAUUCACUCAAUGGAAG | | [1569-1591] 3'UTR |
| 116 | UCUUCCAUUGAGUGAAUGAUGAA | UUCAUCAUUCACUCAAUGGAAGA | | [1568-1590] 3'UTR |
| 117 | GAAUUUAGCCUCCACUCAACAAU | AUUGUUGAGUGGAGGCUAAAUUC | | [2017-2039] 3'UTR |
| 118 | AGAAUUUAGCCUCCACUCAACAA | UUGUUGAGUGGAGGCUAAAUUCU | | [2016-2038] 3'UTR |
| 119 | GAGAAUUUAGCCUCCACUCAACA | UGUUGAGUGGAGGCUAAAUUCUC | | [2015-2037] 3'UTR |
| 120 | AGAGAAUUUAGCCUCCACUCAAC | GUUGAGUGGAGGCUAAAUUCUCU | | [2014-2036] 3'UTR |
| 121 | GAGAGAAUUUAGCCUCCACUCAA | UUGAGUGGAGGCUAAAUUCUCUC | | [2013-2035] 3'UTR |
| 122 | CAGGAUUUCGACUUGUUAAGAAU | UUUCUUAACAAGUCGAAAUCCUG | | [718-740] ORF |
| 123 | UCAGGAUUUCGACUUGUUAAGAA | UUCUUAACAAGUCGAAAUCCUGA | | [717-739] ORF |

TABLE E-continued additional 23 mers

| Number | Sense siRNA | AntiSense siRNA | Other Sp | Hum-34222182 ORF: 204-785 |
|---|---|---|---|---|
| 124 | CUCAGGAUUUCGACUUGUUAAGA | UCUUAACAAGUCGAAAUCCUGAG | | [716-738] ORF |
| 125 | GCUCAGGAUUUCGACUUGUUAAG | CUUAACAAGUCGAAAUCCUGAGC | | [715-737] ORF |
| 126 | AGCUCAGGAUUUCGACUUGUUAA | UUAACAAGUCGAAAUCCUGAGCU | | [714-736] ORF |
| 127 | AUGCACGUGAACUUGGAAAUUGA | UCAAUUUCCAAGUUCACGUGCAU | Dog, Chin, GP, Rat | [525-547] ORF |
| 128 | GUGUGAUCCUGUUACUGAUACUA | UAGUAUCAGUAACAGGAUCACAC | | [2188-2210] 3'UTR |
| 129 | GGUGUGAUCCUGUUACUGAUACU | AGUAUCAGUAACAGGAUCACACC | | [2187-2209] 3'UTR |
| 130 | AGGUGUGAUCCUGUUACUGAUAC | GUAUCAGUAACAGGAUCACACCU | | [2186-2208] 3'UTR |
| 131 | CAGGUGUGAUCCUGUUACUGAUA | UAUCAGUAACAGGAUCACACCUG | | [2185-2207] 3'UTR |
| 132 | ACAGGUGUGAUCCUGUUACUGAU | AUCAGUAACAGGAUCACACCUGU | | [2184-2206] 3'UTR |
| 133 | CAGUAUUACAUGUGCUUAAUCUC | GAGAUUAAGCACAUGUAAUACUG | | [1663-1685] 3'UTR |
| 134 | UCAGUAUUACAUGUGCUUAAUCU | AGAUUAAGCACAUGUAAUACUGA | | [1662-1684] 3'UTR |
| 135 | UUCAGUAUUACAUGUGCUUAAUC | GAUUAAGCACAUGUAAUACUGAA | | [1661-1683] 3'UTR |
| 136 | UUUCAGUAUUACAUGUGCUUAAU | AUUAAGCACAUGUAAUACUGAAA | | [1660-1682] 3'UTR |
| 137 | UUUUCAGUAUUACAUGUGCUUAA | UUAAGCACAUGUAAUACUGAAAA | | [1659-1681] 3'UTR |
| 138 | CCACCUGCCCUAAAUAAGAAACC | GGUUUCUUAUUUAGGGCAGGUGG | | [868-890] 3'UTR |
| 139 | CCCACCUGCCCUAAAUAAGAAAC | GUUUCUUAUUUAGGGCAGGUGGG | | [867-889] 3'UTR |
| 140 | CCCCACCUGCCCUAAAUAAGAAA | UUUCUUAUUUAGGGCAGGUGGGG | | [866-888] 3'UTR |
| 141 | GCCCCACCUGCCCUAAAUAAGAA | UUCUUAUUUAGGGCAGGUGGGGC | | [865-887] 3'UTR |
| 142 | UGCCCCACCUGCCCUAAAUAAGA | UCUUAUUUAGGGCAGGUGGGGCA | | [864-886] 3'UTR |
| 143 | GGUAAGAGUAAUGAGAAAUAUU | AAUAUUUCUCAUUUACUCUUACC | | [1329-1351] 3'UTR |
| 144 | GGAGAACUGUCUGUCCAAAUCAA | UUGAUUUGGACAGACAGUUCUCC | Dog, Chimp | [386-408] ORF |
| 145 | UGGAGAACUGUCUGUCCAAAUCA | UGAUUUGGACAGACAGUUCUCCA | Dog, Chimp | [385-407] ORF |
| 146 | CUGGAGAACUGUCUGUCCAAAUC | GAUUUGGACAGACAGUUCUCCAG | Dog, Chimp | [384-406] ORF |
| 147 | GCUGGAGAACUGUCUGUCCAAAU | AUUUGGACAGACAGUUCUCCAGC | Dog, Chimp | [383-405] ORF |
| 148 | UGCUGGAGAACUGUCUGUCCAAA | UUUGGACAGACAGUUCUCCAGCA | Dog, Chimp | [382-404] ORF |
| 149 | CGAGGUAAUAUUUGAGGAAUCAA | UUGAUUCCUCAAAUAUUACCUCG | Chimp | [338-360] ORF |
| 150 | ACGAGGUAAUAUUUGAGGAAUCA | UGAUUCCUCAAAUAUUACCUCGU | Chimp | [337-359] ORF |
| 151 | AACGAGGUAAUAUUUGAGGAAUC | GAUUCCUCAAAUAUUACCUCGUU | Chimp | [336-358] ORF |
| 152 | CAACGAGGUAAUAUUUGAGGAAU | AUUCCUCAAAUAUUACCUCGUUG | Chimp | [335-357] ORF |
| 153 | UCAACGAGGUAAUAUUUGAGGAA | UUCCUCAAAUAUUACCUCGUUGA | Chimp | [334-356] ORF |
| 154 | GCUUGGAAAGAUACUACAAAGCC | GGCUUUGUAGUAUCUUUCCAAGC | | [2274-2296] 3'UTR |
| 155 | UGCUUGGAAAGAUACUACAAAGC | GCUUUGUAGUAUCUUUCCAAGCA | | [2273-2295] 3'UTR |
| 156 | AUGCUUGGAAAGAUACUACAAAG | CUUUGUAGUAUCUUUCCAAGCAU | | [2272-2294] 3'UTR |
| 157 | AAUGCUUGGAAAGAUACUACAAA | UUUGUAGUAUCUUUCCAAGCAUU | | [2271-2293] 3'UTR |
| 158 | AAAUGCUUGGAAAGAUACUACAA | UUGUAGUAUCUUUCCAAGCAUUU | | [2270-2292] 3'UTR |
| 159 | CUAAAAUGUCACUGUUCAAAUUA | UAAUUUGAACAGUGACAUUUUAG | | [2219-2241] 3'UTR |
| 160 | CCUAAAAUGUCACUGUUCAAAUU | AAUUUGAACAGUGACAUUUUAGG | | [2218-2240] 3'UTR |

TABLE E-continued additional 23 mers

| Number | Sense siRNA | AntiSense siRNA | Other Sp | Hum-34222182 ORF: 204-785 | |
|---|---|---|---|---|---|
| 161 | ACCUAAAAUGUCACUGUUCAAAU | AUUUGAACAGUGACAUUUUAGGU | | [2217-2239] | 3'UTR |
| 162 | GACCUAAAAUGUCACUGUUCAAA | UUUGAACAGUGACAUUUUAGGUC | | [2216-2238] | 3'UTR |
| 163 | UGACCUAAAAUGUCACUGUUCAA | UUGAACAGUGACAUUUUAGGUCA | | [2215-2237] | 3'UTR |
| 164 | GUGACUUCCUCACUCUAAUGUUU | AAACAUUAGAGUGAGGAAGUCAC | | [1385-1407] | 3'UTR |
| 165 | GGUGACUUCCUCACUCUAAUGUU | AACAUUAGAGUGAGGAAGUCACC | | [1384-1406] | 3'UTR |
| 166 | UGGUGACUUCCUCACUCUAAUGU | ACAUUAGAGUGAGGAAGUCACCA | | [1383-1405] | 3'UTR |
| 167 | UUGGUGACUUCCUCACUCUAAUG | CAUUAGAGUGAGGAAGUCACCAA | | [1382-1404] | 3'UTR |
| 168 | CUUGGUGACUUCCUCACUCUAAU | AUUAGAGUGAGGAAGUCACCAAG | | [1381-1403] | 3'UTR |
| 169 | GAAUGGGAUGGAAUAGGUAAGCA | UGCUUACCUAUUCCAUCCCAUUC | | [1025-1047] | 3'UTR |
| 170 | UGAAUGGGAUGGAAUAGGUAAGC | GCUUACCUAUUCCAUCCCAUUCA | | [1024-1046] | 3'UTR |
| 171 | UUGAAUGGGAUGGAAUAGGUAAG | CUUACCUAUUCCAUCCCAUUCAA | | [1023-1045] | 3'UTR |
| 172 | AUUGAAUGGGAUGGAAUAGGUAA | UUACCUAUUCCAUCCCAUUCAAU | | [1022-1044] | 3'UTR |
| 173 | AAUUGAAUGGGAUGGAAUAGGUA | UACCUAUUCCAUCCCAUUCAAUU | | [1021-1043] | 3'UTR |
| 174 | GCCUGUUAUGCUUACAAAAUGGU | ACCAUUUGUAAGCAUAACAGGC | | [2479-2501] | 3'UTR |
| 175 | UGCCUGUUAUGCUUACAAAAUGG | CCAUUUGUAAGCAUAACAGGCA | | [2478-2500] | 3'UTR |
| 176 | UUGCCUGUUAUGCUUACAAAAUG | CAUUUGUAAGCAUAACAGGCAA | | [2477-2499] | 3'UTR |
| 177 | CUUGCCUGUUAUGCUUACAAAAU | AUUUGUAAGCAUAACAGGCAAG | | [2476-2498] | 3'UTR |
| 178 | UCUUGCCUGUUAUGCUUACAAAA | UUUUGUAAGCAUAACAGGCAAGA | | [2475-2497] | 3'UTR |
| 179 | AGGUAGGCUUGGUAAUAGACUAU | AUAGUCUAUUACCAAGCCUACCU | | [1097-1119] | 3'UTR |
| 180 | CAGGUAGGCUUGGUAAUAGACUA | UAGUCUAUUACCAAGCCUACCUG | | [1096-1118] | 3'UTR |
| 181 | UCAGGUAGGCUUGGUAAUAGACU | AGUCUAUUACCAAGCCUACCUGA | | [1095-1117] | 3'UTR |
| 182 | UUCAGGUAGGCUUGGUAAUAGAC | GUCUAUUACCAAGCCUACCUGAA | | [1094-1116] | 3'UTR |
| 183 | UUUCAGGUAGGCUUGGUAAUAGA | UCUAUUACCAAGCCUACCUGAAA | | [1093-1115] | 3'UTR |
| 184 | GAUGAAUACCUGUGAGGAUAGGA | UCCUAUCCUCACAGGUAUUCAUC | | [1585-1607] | 3'UTR |
| 185 | UGAUGAAUACCUGUGAGGAUAGG | CCUAUCCUCACAGGUAUUCAUCA | | [1584-1606] | 3'UTR |
| 186 | AUGAUGAAUACCUGUGAGGAUAG | CUAUCCUCACAGGUAUUCAUCAU | | [1583-1605] | 3'UTR |
| 187 | AAUGAUGAAUACCUGUGAGGAUA | UAUCCUCACAGGUAUUCAUCAUU | | [1582-1604] | 3'UTR |
| 188 | CUGUCACUAGGGAAUAAUAAAGG | CCUUUAUUAUUCCCUAGUGACAG | | [1929-1951] | 3'UTR |
| 189 | CCUGUCACUAGGGAAUAAUAAAG | CUUUAUUAUUCCCUAGUGACAGG | | [1928-1950] | 3'UTR |
| 190 | ACCUGUCACUAGGGAAUAAUAAA | UUUAUUAUUCCCUAGUGACAGGU | | [1927-1949] | 3'UTR |
| 191 | UACCUGUCACUAGGGAAUAAUAA | UUAUUAUUCCCUAGUGACAGGUA | | [1926-1948] | 3'UTR |
| 192 | AUACCUGUCACUAGGGAAUAAUA | UAUUAUUCCCUAGUGACAGGUAU | | [1925-1947] | 3'UTR |
| 193 | GUUUUAAAGAGGCAACAAAAGCU | AGCUUUUGUUGCCUCUUUAAAAC | | [1404-1426] | 3'UTR |
| 194 | UGUUUUAAAGAGGCAACAAAAGC | GCUUUUGUUGCCUCUUUAAAACA | | [1403-1425] | 3'UTR |
| 195 | AUGUUUUAAAGAGGCAACAAAAG | CUUUUGUUGCCUCUUUAAAACAU | | [1402-1424] | 3'UTR |
| 196 | AAUGUUUUAAAGAGGCAACAAAA | UUUUGUUGCCUCUUUAAAACAUU | | [1401-1423] | 3'UTR |
| 197 | UAAUGUUUUAAAGAGGCAACAAA | UUUGUUGCCUCUUUAAAACAUUA | | [1400-1422] | 3'UTR |

TABLE E-continued additional 23 mers

| Number | Sense siRNA | AntiSense siRNA | Other Sp | Hum-34222182 ORF: 204-785 |
|---|---|---|---|---|
| 198 | GUGUUCUAACAAACUAAACUCUU | AAGAGUUUAGUUUGUUAGAACAC | | [2246-2268] 3'UTR |
| 199 | AGUGUUCUAACAAACUAAACUCU | AGAGUUUAGUUUGUUAGAACACU | | [2245-2267] 3'UTR |
| 200 | GCUUGGUAAUAGACUAUAUAAAC | GUUUAUAGUCUAUUACCAAGC | | [1103-1125] 3'UTR |
| 201 | GGCUUGGUAAUAGACUAUAUAAA | UUUAUAGUCUAUUACCAAGCC | | [1102-1124] 3'UTR |
| 202 | AGGCUUGGUAAUAGACUAUAUA | UUAUAGUCUAUUACCAAGCCU | | [1101-1123] 3'UTR |
| 203 | UAGGCUUGGUAAUAGACUAUAUA | UAUAUAGUCUAUUACCAAGCCUA | | [1100-1122] 3'UTR |
| 204 | GUAGGCUUGGUAAUAGACUAUAU | AUAUAGUCUAUUACCAAGCCUAC | | [1099-1121] 3'UTR |
| 205 | CAUCCUGGUGUUACUGAAAAACA | UGUUUUCAGUAACACCAGGAUG | | [2164-2186] 3'UTR |
| 206 | UCAUCCUGGUGUUACUGAAAAAC | GUUUUCAGUAACACCAGGAUGA | | [2163-2185] 3'UTR |
| 207 | UUCAUCCUGGUGUUACUGAAAAA | UUUUCAGUAACACCAGGAUGAA | | [2162-2184] 3'UTR |
| 208 | AUUCAUCCUGGUGUUACUGAAAA | UUUUCAGUAACACCAGGAUGAAU | | [2161-2183] 3'UTR |
| 209 | UAUUCAUCCUGGUGUUACUGAAA | UUUCAGUAACACCAGGAUGAAUA | | [2160-2182] 3'UTR |
| 210 | GCCUAUCAAACUUCCAAAAGCC | GGCUUUUGGAAGUUUUGAUAGGC | | [1218-1240] 3'UTR |
| 211 | AGCCUAUCAAACUUCCAAAAGC | GCUUUUGGAAGUUUUGAUAGGCU | | [1217-1239] 3'UTR |
| 212 | UAGCCUAUCAAACUUCCAAAAG | CUUUUGGAAGUUUUGAUAGGCUA | | [1216-1238] 3'UTR |
| 213 | UUAGCCUAUCAAACUUCCAAAA | UUUUGGAAGUUUUGAUAGGCUAA | | [1215-1237] 3'UTR |
| 214 | UUUAGCCUAUCAAACUUCCAAA | UUUGGAAGUUUUGAUAGGCUAAA | | [1214-1236] 3'UTR |
| 215 | UCCUGGUGUUACUGAAAAACAGG | CCUGUUUUCAGUAACACCAGGA | | [2166-2188] 3'UTR |
| 216 | AUCCUGGUGUUACUGAAAAACAG | CUGUUUUCAGUAACACCAGGAU | | [2165-2187] 3'UTR |
| 217 | CCACGGUGUUGUUUUAGAUGCCU | AGGCAUCUAAAACAACACCGUGG | | [1446-1468] 3'UTR |
| 218 | ACCACGGUGUUGUUUUAGAUGCC | GGCAUCUAAAACAACACCGUGGU | | [1445-1467] 3'UTR |
| 219 | AACCACGGUGUUGUUUUAGAUGC | GCAUCUAAAACAACACCGUGGUU | | [1444-1466] 3'UTR |
| 220 | UAACCACGGUGUUGUUUUAGAUG | CAUCUAAAACAACACCGUGGUUA | | [1443-1465] 3'UTR |
| 221 | GUAACCACGGUGUUGUUUUAGAU | AUCUAAAACAACACCGUGGUUAC | | [1442-1464] 3'UTR |
| 222 | ACAAAAUGGUGAUGGCUUAUGGA | UCCAUAAGCCAUCACCAUUUUGU | | [2492-2514] 3'UTR |
| 223 | UACAAAAUGGUGAUGGCUUAUGG | CCAUAAGCCAUCACCAUUUUGUA | | [2491-2513] 3'UTR |
| 224 | UUACAAAAUGGUGAUGGCUUAUG | CAUAAGCCAUCACCAUUUUGUAA | | [2490-2512] 3'UTR |
| 225 | CUUACAAAAUGGUGAUGGCUUAU | AUAAGCCAUCACCAUUUUGUAAG | | [2489-2511] 3'UTR |
| 226 | GCUUACAAAAUGGUGAUGGCUUA | UAAGCCAUCACCAUUUUGUAAGC | | [2488-2510] 3'UTR |
| 227 | GCAGUUUGAGCAGCAAGAACCCG | CGGGUUCUUGCUGCUCAAACUGC | Chimp | [217-239] ORF |
| 228 | GGCAGUUUGAGCAGCAAGAACCC | GGGUUCUUGCUGCUCAAACUGCC | Chimp | [216-238] ORF |
| 229 | UGGCAGUUUGAGCAGCAAGAACC | GGUUCUUGCUGCUCAAACUGCCA | Chimp | [215-237] ORF |
| 230 | CUGGCAGUUUGAGCAGCAAGAAC | GUUCUUGCUGCUCAAACUGCCAG | Chimp | [214-236] ORF |
| 231 | ACUGGCAGUUUGAGCAGCAAGAA | UUCUUGCUGCUCAAACUGCCAGU | Chimp | [213-235] ORF |
| 232 | CUUGGAAAGAUACUACAAAGCCA | UGGCUUUGUAGUAUCUUUCCAAG | | [2275-2297] 3'UTR |
| 233 | GUGUGAUUCUAGCGUCGUACCUA | UAGGUACGACGCUAGAAUCACAC | | [578-600] ORF |
| 234 | UGUGUGAUUCUAGCGUCGUACCU | AGGUACGACGCUAGAAUCACACA | | [577-599] ORF |

TABLE E-continued additional 23 mers

| Number | Sense siRNA | AntiSense siRNA | Other Sp | Hum-34222182 ORF: 204-785 | |
|---|---|---|---|---|---|
| 235 | GUGUGUGAUUCUAGCGUCGUACC | GGUACGACGCUAGAAUCACACAC | | [576-598] | ORF |
| 236 | UGUGUGAUUCUAGCGUCGUAC | GUACGACGCUAGAAUCACACACA | | [575-597] | ORF |
| 237 | UUGUGUGAUUCUAGCGUCGUA | UACGACGCUAGAAUCACACACAA | | [574-596] | ORF |
| 238 | CUUGGGCAUCGAUGUAGAACUGU | ACAGUUCUACAUCGAUGCCCAAG | | [2419-2441] | 3'UTR |
| 239 | UCUUGGGCAUCGAUGUAGAACUG | CAGUUCUACAUCGAUGCCCAAGA | | [2418-2440] | 3'UTR |
| 240 | UUCUUGGGCAUCGAUGUAGAACU | AGUUCUACAUCGAUGCCCAAGAA | | [2417-2439] | 3'UTR |
| 241 | CUUCUUGGGCAUCGAUGUAGAAC | GUUCUACAUCGAUGCCCAAGAAG | | [2416-2438] | 3'UTR |
| 242 | GCUUCUUGGGCAUCGAUGUAGAA | UUCUACAUCGAUGCCCAAGAAGC | | [2415-2437] | 3'UTR |
| 243 | CUCUGGGCUUUUCUGGGAAUUGA | UCAAUUCCCAGAAAAGCCCAGAG | | [1721-1743] | 3'UTR |
| 244 | AACUGUCUGUCCAAAUCAAAGCA | UGCUUUGAUUUGGACAGACAGUU | Dog, Chimp | [390-412] | ORF |
| 245 | GAACUGUCUGUCCAAAUCAAAGC | GCUUUGAUUUGGACAGACAGUUC | Dog, Chimp | [389-411] | ORF |
| 246 | AGAACUGUCUGUCCAAAUCAAAG | CUUUGAUUUGGACAGACAGUUCU | Dog, Chimp | [388-410] | ORF |
| 247 | GAGAACUGUCUGUCCAAAUCAAA | UUUGAUUUGGACAGACAGUUCUC | Dog, Chimp | [387-409] | ORF |
| 248 | GAAGGGUCCUAAAAAGGGAAAAU | AUUUUCCCUUUUUAGGACCCUUC | | [774-796] | ORF + 3'UTR |
| 249 | UGAAGGGUCCUAAAAAGGGAAAA | UUUUCCCUUUUUAGGACCCUUCA | | [773-795] | ORF + 3'UTR |
| 250 | UUGAAGGGUCCUAAAAAGGGAAA | UUUCCCUUUUUAGGACCCUUCAA | | [772-794] | ORF + 3'UTR |
| 251 | AUUGAAGGGUCCUAAAAAGGGAA | UUCCCUUUUUAGGACCCUUCAAU | | [771-793] | ORF + 3'UTR |
| 252 | AAAGCUUAACCCUAGGUAAGAGU | ACUCUUACCUAGGGUUAAGCUUU | | [1315-1337] | 3'UTR |
| 253 | UAAAGCUUAACCCUAGGUAAGAG | CUCUUACCUAGGGUUAAGCUUUA | | [1314-1336] | 3'UTR |
| 254 | UUAAAGCUUAACCCUAGGUAAGA | UCUUACCUAGGGUUAAGCUUUAA | | [1313-1335] | 3'UTR |
| 255 | AUUAAAGCUUAACCCUAGGUAAG | CUUACCUAGGGUUAAGCUUUAAU | | [1312-1334] | 3'UTR |
| 256 | AAUUAAAGCUUAACCCUAGGUAA | UUACCUAGGGUUAAGCUUUAAUU | | [1311-1333] | 3'UTR |
| 257 | ACAUGUGCUUAAUCUCAGAUGAA | UUCAUCUGAGAUUAAGCACAUGU | | [1670-1692] | 3'UTR |
| 258 | UACAUGUGCUUAAUCUCAGAUGA | UCAUCUGAGAUUAAGCACAUGUA | | [1669-1691] | 3'UTR |
| 259 | UUACAUGUGCUUAAUCUCAGAUG | CAUCUGAGAUUAAGCACAUGUAA | | [1668-1690] | 3'UTR |
| 260 | AUUACAUGUGCUUAAUCUCAGAU | AUCUGAGAUUAAGCACAUGUAAU | | [1667-1689] | 3'UTR |
| 261 | UAUUACAUGUGCUUAAUCUCAGA | UCUGAGAUUAAGCACAUGUAAUA | | [1666-1688] | 3'UTR |
| 262 | GAAUCAACUUGCCAGAAUUUGGU | ACCAAAUUCUGGCAAGUUGAUUC | Chimp | [354-376] | ORF |
| 263 | GGAAUCAACUUGCCAGAAUUUGG | CCAAAUUCUGGCAAGUUGAUUCC | Chimp | [353-375] | ORF |
| 264 | AGGAAUCAACUUGCCAGAAUUUG | CAAAUUCUGGCAAGUUGAUUCCU | Chimp | [352-374] | ORF |
| 265 | GAGGAAUCAACUUGCCAGAAUUU | AAAUUCUGGCAAGUUGAUUCCUC | Chimp | [351-373] | ORF |
| 266 | UGAGGAAUCAACUUGCCAGAAUU | AAUUCUGGCAAGUUGAUUCCUCA | Chimp | [350-372] | ORF |
| 267 | UCCUCACUCUAAUGUUUUAAAGA | UCUUUAAAACAUUAGAGUGAGGA | | [1391-1413] | 3'UTR |
| 268 | UUCCUCACUCUAAUGUUUUAAAG | CUUUAAAACAUUAGAGUGAGGAA | | [1390-1412] | 3'UTR |
| 269 | CUUCCUCACUCUAAUGUUUUAAA | UUUAAAACAUUAGAGUGAGGAAG | | [1389-1411] | 3'UTR |
| 270 | ACUUCCUCACUCUAAUGUUUUAA | UUAAAACAUUAGAGUGAGGAAGU | | [1388-1410] | 3'UTR |
| 271 | GACUUCCUCACUCUAAUGUUUUA | UAAAACAUUAGAGUGAGGAAGUC | | [1387-1409] | 3'UTR |

TABLE E-continued additional 23 mers

| Number | Sense siRNA | AntiSense siRNA | Other Sp | Hum-34222182 ORF: 204-785 | |
|---|---|---|---|---|---|
| 272 | GAAAGAUACUACAAAGCCAAUCU | AGAUUGGCUUUGUAGUAUCUUUC | | [2279-2301] | 3'UTR |
| 273 | GGAAAGAUACUACAAAGCCAAUC | GAUUGGCUUUGUAGUAUCUUUCC | | [2278-2300] | 3'UTR |
| 274 | UGGAAAGAUACUACAAAGCCAAU | AUUGGCUUUGUAGUAUCUUUCCA | | [2277-2299] | 3'UTR |
| 275 | UUGGAAAGAUACUACAAAGCCAA | UUGGCUUUGUAGUAUCUUUCCAA | | [2276-2298] | 3'UTR |
| 276 | AAGGGUUUUUAGACAGGAAGGUA | UACCUUCCUGUCUAAAAACCCUU | | [1269-1291] | 3'UTR |
| 277 | GAAGGGUUUUUAGACAGGAAGGU | ACCUUCCUGUCUAAAAACCCUUC | | [1268-1290] | 3'UTR |
| 278 | UGAAGGGUUUUUAGACAGGAAGG | CCUUCCUGUCUAAAAACCCUUCA | | [1267-1289] | 3'UTR |
| 279 | UUGAAGGGUUUUUAGACAGGAAG | CUUCCUGUCUAAAAACCCUUCAA | | [1266-1288] | 3'UTR |
| 280 | UUUGAAGGGUUUUUAGACAGGAA | UUCCUGUCUAAAAACCCUUCAAA | | [1265-1287] | 3'UTR |
| 281 | GUAUUCAUCCUGGUGUUACUGAA | UUCAGUAACACCAGGAUGAAUAC | | [2159-2181] | 3'UTR |
| 282 | CCUGUUACUGAUACUAUAAGUGA | UCACUUAUAGUAUCAGUAACAGG | | [2195-2217] | 3'UTR |
| 283 | GGAGAUAUGGUUUAUAGUACAGC | GCUGUACUAUAAACCAUAUCUCC | | [1841-1863] | 3'UTR |
| 284 | UGGAGAUAUGGUUUAUAGUACAG | CUGUACUAUAAACCAUAUCUCCA | | [1840-1862] | 3'UTR |
| 285 | AUGGAGAUAUGGUUUAUAGUACA | UGUACUAUAAACCAUAUCUCCAU | | [1839-1861] | 3'UTR |
| 286 | UAUGGAGAUAUGGUUUAUAGUAC | GUACUAUAAACCAUAUCUCCAUA | | [1838-1860] | 3'UTR |
| 287 | CUAUGGAGAUAUGGUUUAUAGUA | UACUAUAAACCAUAUCUCCAUAG | | [1837-1859] | 3'UTR |
| 288 | CAUAGAUCCCAUUUUUGUACAGA | UCUGUACAAAAAUGGGAUCUAUG | | [999-1021] | 3'UTR |
| 289 | GCAUAGAUCCCAUUUUUGUACAG | CUGUACAAAAAUGGGAUCUAUGC | | [998-1020] | 3'UTR |
| 290 | UGCAUAGAUCCCAUUUUUGUACA | UGUACAAAAAUGGGAUCUAUGCA | | [997-1019] | 3'UTR |
| 291 | CUGCAUAGAUCCCAUUUUUGUAC | GUACAAAAAUGGGAUCUAUGCAG | | [996-1018] | 3'UTR |
| 292 | UCUGCAUAGAUCCCAUUUUUGUA | UACAAAAAUGGGAUCUAUGCAGA | | [995-1017] | 3'UTR |
| 293 | GAAUUGAAUGGGAUGGAAUAGGU | ACCUAUUCCAUCCCAUUCAAUUC | | [1020-1042] | 3'UTR |
| 294 | AGAAUUGAAUGGGAUGGAAUAGG | CCUAUUCCAUCCCAUUCAAUUCU | | [1019-1041] | 3'UTR |
| 295 | CAGAAUUGAAUGGGAUGGAAUAG | CUAUUCCAUCCCAUUCAAUUCUG | | [1018-1040] | 3'UTR |
| 296 | ACAGAAUUGAAUGGGAUGGAAUA | UAUUCCAUCCCAUUCAAUUCUGU | | [1017-1039] | 3'UTR |
| 297 | CUGUGAGGAUAGGAAAUUAGUUC | GAACUAAUUUCCUAUCCUCACAG | | [1594-1616] | 3'UTR |
| 298 | CCUGUGAGGAUAGGAAAUUAGUU | AACUAAUUUCCUAUCCUCACAGG | | [1593-1615] | 3'UTR |
| 299 | ACCUGUGAGGAUAGGAAAUUAGU | ACUAAUUUCCUAUCCUCACAGGU | | [1592-1614] | 3'UTR |
| 300 | UACCUGUGAGGAUAGGAAAUUAG | CUAAUUUCCUAUCCUCACAGGUA | | [1591-1613] | 3'UTR |
| 301 | AUACCUGUGAGGAUAGGAAAUUA | UAAUUUCCUAUCCUCACAGGUAU | | [1590-1612] | 3'UTR |
| 302 | ACCCUAGGUAAGAGUAAAUGAGA | UCUCAUUUACUCUUACCUAGGGU | | [1323-1345] | 3'UTR |
| 303 | AACCCUAGGUAAGAGUAAAUGAG | CUCAUUUACUCUUACCUAGGGUU | | [1322-1344] | 3'UTR |
| 304 | UAACCCUAGGUAAGAGUAAAUGA | UCAUUUACUCUUACCUAGGGUUA | | [1321-1343] | 3'UTR |
| 305 | UCAAAUGCUUGGAAAGAUACUAC | GUAGUAUCUUUCCAAGCAUUUGA | | [2268-2290] | 3'UTR |
| 306 | UUCAAAUGCUUGGAAAGAUACUA | UAGUAUCUUUCCAAGCAUUUGAA | | [2267-2289] | 3'UTR |
| 307 | CUUCAAAUGCUUGGAAAGAUACU | AGUAUCUUUCCAAGCAUUUGAAG | | [2266-2288] | 3'UTR |
| 308 | UCUUCAAAUGCUUGGAAAGAUAC | GUAUCUUUCCAAGCAUUUGAAGA | | [2265-2287] | 3'UTR |

TABLE E-continued additional 23 mers

| Number | Sense siRNA | AntiSense siRNA | Other Sp | Hum-34222182 ORF: 204-785 |
|---|---|---|---|---|
| 309 | CUCUUCAAAUGCUUGGAAAGAUA | UAUCUUUCCAAGCAUUUGAAGAG | | [2264-2286] 3'UTR |
| 310 | GGAGAAGUGAUUCAAAAUAGUGU | ACACUAUUUUGAAUCACUUCUCC | | [966-988] 3'UTR |
| 311 | UGGAGAAGUGAUUCAAAAUAGUG | CACUAUUUUGAAUCACUUCUCCA | | [965-987] 3'UTR |
| 312 | UUGGAGAAGUGAUUCAAAAUAGU | ACUAUUUUGAAUCACUUCUCCAA | | [964-986] 3'UTR |
| 313 | UUUGGAGAAGUGAUUCAAAAUAG | CUAUUUUGAAUCACUUCUCCAAA | | [963-985] 3'UTR |
| 314 | CUUUGGAGAAGUGAUUCAAAAUA | UAUUUUGAAUCACUUCUCCAAAG | | [962-984] 3'UTR |
| 315 | CGUGGAUAAGGAGCUUAUUCAGG | CCUGAAUAAGCUCCUUAUCCACG | | [2078-2100] 3'UTR |
| 316 | UCGUGGAUAAGGAGCUUAUUCAG | CUGAAUAAGCUCCUUAUCCACGA | | [2077-2099] 3'UTR |
| 317 | GUCGUGGAUAAGGAGCUUAUUCA | UGAAUAAGCUCCUUAUCCACGAC | | [2076-2098] 3'UTR |
| 318 | GGUCGUGGAUAAGGAGCUUAUUC | GAAUAAGCUCCUUAUCCACGACC | | [2075-2097] 3'UTR |
| 319 | GGGUCGUGGAUAAGGAGCUUAUU | AAUAAGCUCCUUAUCCACGACCC | | [2074-2096] 3'UTR |
| 320 | CCAGAUUUGCCUAUUUUGAUUUU | AAAAUCAAAAUAGGCAAAUCUGG | | [1125-1147] 3'UTR |
| 321 | ACCAGAUUUGCCUAUUUUGAUUU | AAAUCAAAAUAGGCAAAUCUGGU | | [1124-1146] 3'UTR |
| 322 | AACCAGAUUUGCCUAUUUUGAUU | AAUCAAAAUAGGCAAAUCUGGUU | | [1123-1145] 3'UTR |
| 323 | AAACCAGAUUUGCCUAUUUUGAU | AUCAAAAUAGGCAAAUCUGGUUU | | [1122-1144] 3'UTR |
| 324 | UAAACCAGAUUUGCCUAUUUUGA | UCAAAAUAGGCAAAUCUGGUUUA | | [1121-1143] 3'UTR |
| 325 | CCUUUGGAGAAGUGAUUCAAAAU | AUUUUGAAUCACUUCUCCAAAGG | | [961-983] 3'UTR |
| 326 | GCCUUUGGAGAAGUGAUUCAAAA | UUUUGAAUCACUUCUCCAAAGGC | | [960-982] 3'UTR |
| 327 | UUGAGGAAUCAACUUGCCAGAAU | AUUCUGGCAAGUUGAUUCCUCAA | Chimp | [349-371] ORF |
| 328 | UUUGAGGAAUCAACUUGCCAGAA | UUCUGGCAAGUUGAUUCCUCAAA | Chimp | [348-370] ORF |
| 329 | AUUUGAGGAAUCAACUUGCCAGA | UCUGGCAAGUUGAUUCCUCAAAU | Chimp | [347-369] ORF |
| 330 | GAGAAAUAUUACGGCAAUAAUGG | CCAUUAUUGCCGUAAUAUUUCUC | | [1342-1364] 3'UTR |
| 331 | UGAGAAAUAUUACGGCAAUAAUG | CAUUAUUGCCGUAAUAUUUCUCA | | [1341-1363] 3'UTR |
| 332 | AUGAGAAAUAUUACGGCAAUAAU | AUUAUUGCCGUAAUAUUUCUCAU | | [1340-1362] 3'UTR |
| 333 | AAUGAGAAAUAUUACGGCAAUAA | UUAUUGCCGUAAUAUUUCUCAUU | | [1339-1361] 3'UTR |
| 334 | AAAUGAGAAAUAUUACGGCAAUA | UAUUGCCGUAAUAUUUCUCAUUU | | [1338-1360] 3'UTR |
| 335 | UACAGAAUUGAAUGGGAUGGAAU | AUUCCAUCCCAUUCAAUUCUGUA | | [1016-1038] 3'UTR |
| 336 | GUACAGAAUUGAAUGGGAUGGAA | UUCCAUCCCAUUCAAUUCUGUAC | | [1015-1037] 3'UTR |
| 337 | AUGGAAUAGGUAAGCAAAAGUAG | CUACUUUUGCUUACCUAUUCCAU | | [1032-1054] 3'UTR |
| 338 | GUAAAAGCUGGAUAGGAUUGUG | CACAAUCCUAUCCAGCUUUUUAC | Chin, GP, Chimp, Rat, Ms | [556-578] ORF |
| 339 | UGUAAAAGCUGGAUAGGAUUGU | ACAAUCCUAUCCAGCUUUUUACA | Chin, GP, Chimp, Rat, Ms | [555-577] ORF |
| 340 | AUGUAAAAGCUGGAUAGGAUUG | CAAUCCUAUCCAGCUUUUUACAU | Chin, GP, Chimp, Rat, Ms | [554-576] ORF |
| 341 | UAUGUAAAAGCUGGAUAGGAUU | AAUCCUAUCCAGCUUUUUACAUA | Chin, GP, Chimp, Rat, Ms | [553-575] ORF |
| 342 | GUAUGUAAAAGCUGGAUAGGAU | AUCCUAUCCAGCUUUUUACAUAC | Chin, GP, Chimp, Rat, Ms | [552-574] ORF |
| 343 | CCACCAGUUCCUGACUCAAAUUU | AAAUUUGAGUCAGGAACUGGUGG | | [1245-1267] 3'UTR |
| 344 | ACCACCAGUUCCUGACUCAAAUU | AAUUUGAGUCAGGAACUGGUGGU | | [1244-1266] 3'UTR |
| 345 | CACCACCAGUUCCUGACUCAAAU | AUUUGAGUCAGGAACUGGUGGUG | | [1243-1265] 3'UTR |

TABLE E-continued additional 23 mers

| Number | Sense siRNA | AntiSense siRNA | Other Sp | Hum-34222182 ORF: 204-785 |
|---|---|---|---|---|
| 346 | ACACCACCAGUUCCUGACUCAAA | UUUGAGUCAGGAACUGGUGGUGU | | [1242-1264] 3'UTR |
| 347 | CACACCACCAGUUCCUGACUCAA | UUGAGUCAGGAACUGGUGGUGUG | | [1241-1263] 3'UTR |
| 348 | CAAAUUAGCCAGUGUUCUAACAA | UUGUUAGAACACUGGCUAAUUUG | | [2235-2257] 3'UTR |
| 349 | UCAAAUUAGCCAGUGUUCUAACA | UGUUAGAACACUGGCUAAUUUGA | | [2234-2256] 3'UTR |
| 350 | UUCAAAUUAGCCAGUGUUCUAAC | GUUAGAACACUGGCUAAUUUGAA | | [2233-2255] 3'UTR |
| 351 | GUUCAAAUUAGCCAGUGUUCUAA | UUAGAACACUGGCUAAUUUGAAC | | [2232-2254] 3'UTR |
| 352 | UGUUCAAAUUAGCCAGUGUUCUA | UAGAACACUGGCUAAUUUGAACA | | [2231-2253] 3'UTR |
| 353 | CACCUGCCCUAAAUAAGAAACCC | GGGUUUCUUAUUUAGGGCAGGUG | | [869-891] 3'UTR |
| 354 | CUCACUGAUUGGAACAACAGUGA | UCACUGUUGUUCCAAUCAGUGAG | | [749-771] ORF |
| 355 | ACUCACUGAUUGGAACAACAGUG | CACUGUUGUUCCAAUCAGUGAGU | | [748-770] ORF |
| 356 | UACUCACUGAUUGGAACAACAGU | ACUGUUGUUCCAAUCAGUGAGUA | | [747-769] ORF |
| 357 | UUACUCACUGAUUGGAACAACAG | CUGUUGUUCCAAUCAGUGAGUAA | | [746-768] ORF |
| 358 | UUUACUCACUGAUUGGAACAACA | UGUUGUUCCAAUCAGUGAGUAAA | | [745-767] ORF |
| 359 | AUGCUGGAGAACUGUCUGUCCAA | UUGGACAGACAGUUCUCCAGCAU | Dog, GP, Chimp, Rat | [381-403] ORF |
| 360 | UUUAUAGAAUUGGGCCAAGAUAA | UUAUCUUGGCCCAAUUCUAUAAA | | [2301-2323] 3'UTR |
| 361 | ACUCUUCAAAUGCUUGGAAAGAU | AUCUUUCCAAGCAUUUGAAGAGU | | [2263-2285] 3'UTR |
| 362 | AACUCUUCAAAUGCUUGGAAAGA | UCUUUCCAAGCAUUUGAAGAGUU | | [2262-2284] 3'UTR |
| 363 | AAACUCUUCAAAUGCUUGGAAAG | CUUUCCAAGCAUUUGAAGAGUUU | | [2261-2283] 3'UTR |
| 364 | UAAACUCUUCAAAUGCUUGGAAA | UUUCCAAGCAUUUGAAGAGUUUA | | [2260-2282] 3'UTR |
| 365 | UCUUGGUGACUUCCUCACUCUAA | UUAGAGUGAGGAAGUCACCAAGA | | [1380-1402] 3'UTR |
| 366 | GAGAACUGCUCAUGGACUAGCUU | AAGCUAGUCCAUGAGCAGUUCUC | Dog, Chimp | [630-652] ORF |
| 367 | GGAGAACUGCUCAUGGACUAGCU | AGCUAGUCCAUGAGCAGUUCUCC | Dog, Chimp | [629-651] ORF |
| 368 | AGGAGAACUGCUCAUGGACUAGC | GCUAGUCCAUGAGCAGUUCUCCU | Dog, Chimp | [628-650] ORF |
| 369 | CAGGAGAACUGCUCAUGGACUAG | CUAGUCCAUGAGCAGUUCUCCUG | Dog, Chimp | [627-649] ORF |
| 370 | GCAGGAGAACUGCUCAUGGACUA | UAGUCCAUGAGCAGUUCUCCUGC | Dog, Chimp | [626-648] ORF |
| 371 | UGUGGGUCGUGGAUAAGGAGCUU | AAGCUCCUUAUCCACGACCCACA | | [2071-2093] 3'UTR |
| 372 | CUGUGGGUCGUGGAUAAGGAGCU | AGCUCCUUAUCCACGACCCACAG | | [2070-2092] 3'UTR |
| 373 | GCUGUGGGUCGUGGAUAAGGAGC | GCUCCUUAUCCACGACCCACAGC | | [2069-2091] 3'UTR |
| 374 | GUGACCUAAAAUGUCACUGUUCA | UGAACAGUGACAUUUUAGGUCAC | | [2214-2236] 3'UTR |
| 375 | GAGAAACUGACCCAGAGAAUUGC | GCAAUUCUCUGGGUCAGUUUCUC | Chin, GP, Chimp, Rat, Ms | [447-469] ORF |
| 376 | UGAGAAACUGACCCAGAGAAUUG | CAAUUCUCUGGGUCAGUUUCUCA | Chin, GP, Chimp, Rat, Ms | [446-468] ORF |
| 377 | CUGAGAAACUGACCCAGAGAAUU | AAUUCUCUGGGUCAGUUUCUCAG | Chin, GP, Chimp, Rat, Ms | [445-467] ORF |
| 378 | CCUGAGAAACUGACCCAGAGAAU | AUUCUCUGGGUCAGUUUCUCAGG | Chin, GP, Chimp, Rat, Ms | [444-466] ORF |
| 379 | CCCUGAGAAACUGACCCAGAGAA | UUCUCUGGGUCAGUUUCUCAGGG | Chin, GP, Chimp, Rat, Ms | [443-465] ORF |
| 380 | CACCAGUUCCUGACUCAAAUUUG | CAAAUUUGAGUCAGGAACUGGUG | | [1246-1268] 3'UTR |
| 381 | UCAAAGGUCCUUGUCCCUGAGAA | UUCUCAGGGACAAGGACCUUUGA | Chimp | [429-451] ORF |
| 382 | CUCAAAGGUCCUUGUCCCUGAGA | UCUCAGGGACAAGGACCUUUGAG | Chimp | [428-450] ORF |

TABLE E-continued additional 23 mers

| Number | Sense siRNA | AntiSense siRNA | Other Sp | Hum-34222182 ORF: 204-785 |
|---|---|---|---|---|
| 383 | GCUCAAAGGUCCUUGUCCCUGAG | CUCAGGGACAAGGACCUUUGAGC | Chimp | [427-449] ORF |
| 384 | UGCUCAAAGGUCCUUGUCCCUGA | UCAGGGACAAGGACCUUUGAGCA | Chimp | [426-448] ORF |
| 385 | GAUUUCGACUUGUUAAGAAAAAA | UUUUUUCUUAACAAGUCGAAAUC | Rat | [721-743] ORF |
| 386 | GGAUUUCGACUUGUUAAGAAAAA | UUUUUCUUAACAAGUCGAAAUCC | Rat | [720-742] ORF |
| 387 | AGGAUUUCGACUUGUUAAGAAAA | UUUUCUUAACAAGUCGAAAUCCU | Rat | [719-741] ORF |
| 388 | UGAGUGAAUGAUGAAUACCUGUG | CACAGGUAUUCAUCAUUCACUCA | | [1576-1598] 3'UTR |
| 389 | UUGAGUGAAUGAUGAAUACCUGU | ACAGGUAUUCAUCAUUCACUCAA | | [1575-1597] 3'UTR |
| 390 | AUUGAGUGAAUGAUGAAUACCUG | CAGGUAUUCAUCAUUCACUCAAU | | [1574-1596] 3'UTR |
| 391 | CAUUGAGUGAAUGAUGAAUACCU | AGGUAUUCAUCAUUCACUCAAUG | | [1573-1595] 3'UTR |
| 392 | CAAUAAUGGAACUGCUUCACUGU | ACAGUGAAGCAGUUCCAUUAUUG | | [1356-1378] 3'UTR |
| 393 | GCAAUAAUGGAACUGCUUCACUG | CAGUGAAGCAGUUCCAUUAUUGC | | [1355-1377] 3'UTR |
| 394 | GGCAAUAAUGGAACUGCUUCACU | AGUGAAGCAGUUCCAUUAUUGCC | | [1354-1376] 3'UTR |
| 395 | CGGCAAUAAUGGAACUGCUUCAC | GUGAAGCAGUUCCAUUAUUGCCG | | [1353-1375] 3'UTR |
| 396 | ACGGCAAUAAUGGAACUGCUUCA | UGAAGCAGUUCCAUUAUUGCCGU | | [1352-1374] 3'UTR |
| 397 | CACUAACAGUUAUCUUUGACUCU | AGAGUCAAAGAUAACUGUUAGUG | | [2453-2475] 3'UTR |
| 398 | CCACUAACAGUUAUCUUUGACUC | GAGUCAAAGAUAACUGUUAGUGG | | [2452-2474] 3'UTR |
| 399 | UCCACUAACAGUUAUCUUUGACU | AGUCAAAGAUAACUGUUAGUGGA | | [2451-2473] 3'UTR |
| 400 | UUCCACUAACAGUUAUCUUUGAC | GUCAAAGAUAACUGUUAGUGGAA | | [2450-2472] 3'UTR |
| 401 | UUUCCACUAACAGUUAUCUUUGA | UCAAAGAUAACUGUUAGUGGAAA | | [2449-2471] 3'UTR |
| 402 | GCGUCGUACCUACUUUUGAGCUU | AAGCUCAAAAGUAGGUACGACGC | | [589-611] ORF |
| 403 | AGCGUCGUACCUACUUUUGAGCU | AGCUCAAAAGUAGGUACGACGCU | | [588-610] ORF |
| 404 | UAGCGUCGUACCUACUUUUGAGC | GCUCAAAAGUAGGUACGACGCUA | | [587-609] ORF |
| 405 | CUAGCGUCGUACCUACUUUUGAG | CUCAAAAGUAGGUACGACGCUAG | | [586-608] ORF |
| 406 | UCUAGCGUCGUACCUACUUUUGA | UCAAAAGUAGGUACGACGCUAGA | | [585-607] ORF |
| 407 | CGGCCAGCAUUUCAGAAUUGCUG | CAGCAAUUCUGAAAUGCUGGCCG | Chimp | [238-260] ORF |
| 408 | CCGGCCAGCAUUUCAGAAUUGCU | AGCAAUUCUGAAAUGCUGGCCGG | Chimp | [237-259] ORF |
| 409 | CCCGGCCAGCAUUUCAGAAUUGC | GCAAUUCUGAAAUGCUGGCCGGG | Chimp | [236-258] ORF |
| 410 | ACCCGGCCAGCAUUUCAGAAUUG | CAAUUCUGAAAUGCUGGCCGGGU | Chimp | [235-257] ORF |
| 411 | AACCCGGCCAGCAUUUCAGAAUU | AAUUCUGAAAUGCUGGCCGGGUU | Chimp | [234-256] ORF |
| 412 | GUGCUUAAUCUCAGAUGAACCAU | AUGGUUCAUCUGAGAUUAAGCAC | | [1674-1696] 3'UTR |
| 413 | UGUGCUUAAUCUCAGAUGAACCA | UGGUUCAUCUGAGAUUAAGCACA | | [1673-1695] 3'UTR |
| 414 | AUGUGCUUAAUCUCAGAUGAACC | GGUUCAUCUGAGAUUAAGCACAU | | [1672-1694] 3'UTR |
| 415 | CAUGUGCUUAAUCUCAGAUGAAC | GUUCAUCUGAGAUUAAGCACAUG | | [1671-1693] 3'UTR |
| 416 | GAAUAGGUAAGCAAAAGUAGAAG | CUUCUACUUUUGCUUACCUAUUC | | [1035-1057] 3'UTR |
| 417 | GGAAUAGGUAAGCAAAAGUAGAA | UUCUACUUUUGCUUACCUAUUCC | | [1034-1056] 3'UTR |
| 418 | UGGAAUAGGUAAGCAAAAGUAGA | UCUACUUUUGCUUACCUAUUCCA | | [1033-1055] 3'UTR |
| 419 | GUUGUGUUAUGCACGUGAACUUG | CAAGUUCACGUGCAUAACACAAC | Ms | [517-539] ORF |

TABLE E-continued additional 23 mers

| Number | Sense siRNA | AntiSense siRNA | Other Sp | Hum-34222182 ORF: 204-785 |
|---|---|---|---|---|
| 420 | GGUUGUGUUAUGCACGUGAACUU | AAGUUCACGUGCAUAACACAACC | Ms | [516-538] ORF |
| 421 | AGGUUGUGUUAUGCACGUGAACU | AGUUCACGUGCAUAACACAACCU | Ms | [515-537] ORF |
| 422 | GAGGUUGUGUUAUGCACGUGAAC | GUUCACGUGCAUAACACAACCUC | Ms | [514-536] ORF |
| 423 | CGAGGUUGUGUUAUGCACGUGAA | UUCACGUGCAUAACACAACCUCG | Ms | [513-535] ORF |
| 424 | AGUACAGCCUAGAGAAUGAAACU | AGUUUCAUUCUCUAGGCUGUACU | | [1856-1878] 3'UTR |
| 425 | UAGUACAGCCUAGAGAAUGAAAC | GUUUCAUUCUCUAGGCUGUACUA | | [1855-1877] 3'UTR |
| 426 | AUAGUACAGCCUAGAGAAUGAAA | UUUCAUUCUCUAGGCUGUACUAU | | [1854-1876] 3'UTR |
| 427 | UAUAGUACAGCCUAGAGAAUGAA | UUCAUUCUCUAGGCUGUACUAUA | | [1853-1875] 3'UTR |
| 428 | UUAUAGUACAGCCUAGAGAAUGA | UCAUUCUCUAGGCUGUACUAUAA | | [1852-1874] 3'UTR |
| 429 | ACUGUCUGUCCAAAUCAAAGCAA | UUGCUUUGAUUUGGACAGACAGU | Dog, Chimp | [391-413] ORF |
| 430 | AGCUUACACUUGUGUUUAAGCAG | CUGCUUAAACACAAGUGUAAGCU | Chimp | [607-629] ORF |
| 431 | GAGCUUACACUUGUGUUUAAGCA | UGCUUAAACACAAGUGUAAGCUC | Chimp | [606-628] ORF |
| 432 | UGAGCUUACACUUGUGUUUAAGC | GCUUAAACACAAGUGUAAGCUCA | Chimp | [605-627] ORF |
| 433 | UUGAGCUUACACUUGUGUUUAAG | CUUAAACACAAGUGUAAGCUCAA | Chimp | [604-626] ORF |
| 434 | UUUGAGCUUACACUUGUGUUUAA | UUAAACACAAGUGUAAGCUCAAA | Chimp | [603-625] ORF |
| 435 | GAUUGGGUAGUAAAACUAUUCAG | CUGAAUAGUUUUACUACCCAAUC | | [815-837] 3'UTR |
| 436 | UGAUUGGGUAGUAAAACUAUUCA | UGAAUAGUUUUACUACCCAAUCA | | [814-836] 3'UTR |
| 437 | AUGAUUGGGUAGUAAAACUAUUC | GAAUAGUUUUACUACCCAAUCAU | | [813-835] 3'UTR |
| 438 | CAUGAUUGGGUAGUAAAACUAUU | AAUAGUUUUACUACCCAAUCAUG | | [812-834] 3'UTR |
| 439 | GUGAACUUGGAAAUUGAAAAUGU | ACAUUUUCAAUUUCCAAGUUCAC | Dog, Chin, GP, Chimp, Rat | [531-553] ORF |
| 440 | GCCAGAAUUUGGUUAAAAUGCUG | CAGCAUUUUAACCAAAUUCUGGC | GP, Chimp, Rat, Ms | [364-386] ORF |
| 441 | UGCCAGAAUUUGGUUAAAAUGCU | AGCAUUUUAACCAAAUUCUGGCA | GP, Chimp, Rat, Ms | [363-385] ORF |
| 442 | UUGCCAGAAUUUGGUUAAAAUGC | GCAUUUUAACCAAAUUCUGGCAA | GP, Chimp, Rat, Ms | [362-384] ORF |
| 443 | CUUGCCAGAAUUUGGUUAAAAUG | CAUUUUAACCAAAUUCUGGCAAG | GP, Chimp, Rat, Ms | [361-383] ORF |
| 444 | ACUUGCCAGAAUUUGGUUAAAAU | AUUUUAACCAAAUUCUGGCAAGU | GP, Chimp, Rat, Ms | [360-382] ORF |
| 445 | AACUGGCAGUUUGAGCAGCAAGA | UCUUGCUGCUCAAACUGCCAGUU | Chimp | [212-234] ORF |
| 446 | CAACUGGCAGUUUGAGCAGCAAG | CUUGCUGCUCAAACUGCCAGUUG | Chimp | [211-233] ORF |
| 447 | GCAACUGGCAGUUUGAGCAGCAA | UUGCUGCUCAAACUGCCAGUUGC | Chimp | [210-232] ORF |
| 448 | GUCACUAGGGAAUAAUAAAGGCC | GGCCUUUAUUAUUCCCUAGUGAC | | [1931-1953] 3'UTR |
| 449 | UGUCACUAGGGAAUAAUAAAGGC | GCCUUUAUUAUUCCCUAGUGACA | | [1930-1952] 3'UTR |
| 450 | AGAUCUAGUCCCUCUCUGAUUCA | UGAAUCAGAGAGGGACUAGAUCU | | [1619-1641] 3'UTR |
| 451 | GAGAUCUAGUCCCUCUCUGAUUC | GAAUCAGAGAGGGACUAGAUCUC | | [1618-1640] 3'UTR |
| 452 | UGAGAUCUAGUCCCUCUCUGAUU | AAUCAGAGAGGGACUAGAUCUCA | | [1617-1639] 3'UTR |
| 453 | CUGAGAUCUAGUCCCUCUCUGAU | AUCAGAGAGGGACUAGAUCUCAG | | [1616-1638] 3'UTR |
| 454 | UCUGAGAUCUAGUCCCUCUCUGA | UCAGAGAGGGACUAGAUCUCAGA | | [1615-1637] 3'UTR |
| 455 | GGCUUCUUGGGCAUCGAUGUAGA | UCUACAUCGAUGCCCAAGAAGCC | | [2414-2436] 3'UTR |
| 456 | CCAGAGAAUUGCUCAAGAUGUCC | GGACAUCUUGAGCAAUUCUCUGG | Chimp, Ms | [458-480] ORF |

TABLE E-continued additional 23 mers

| Number | Sense siRNA | AntiSense siRNA | Other Sp | Hum-34222182 ORF: 204-785 |
|---|---|---|---|---|
| 457 | CCCAGAGAAUUGCUCAAGAUGUC | GACAUCUUGAGCAAUUCUCUGGG | Chimp, Ms | [457-479] ORF |
| 458 | ACCCAGAGAAUUGCUCAAGAUGU | ACAUCUUGAGCAAUUCUCUGGGU | Chimp, Ms | [456-478] ORF |
| 459 | GACCCAGAGAAUUGCUCAAGAUG | CAUCUUGAGCAAUUCUCUGGGUC | Chimp, Ms | [455-477] ORF |
| 460 | UGACCCAGAGAAUUGCUCAAGAU | AUCUUGAGCAAUUCUCUGGGUCA | Chimp, Ms | [454-476] ORF |
| 461 | CCCUGUUCUUAAGUGUUGAAUAC | GUAUUCAACACUUAAGAACAGGG |  | [1485-1507] 3'UTR |
| 462 | CCCCUGUUCUUAAGUGUUGAAUA | UAUUCAACACUUAAGAACAGGGG |  | [1484-1506] 3'UTR |
| 463 | UCCCCUGUUCUUAAGUGUUGAAU | AUUCAACACUUAAGAACAGGGGA |  | [1483-1505] 3'UTR |
| 464 | UUCCCCUGUUCUUAAGUGUUGAA | UUCAACACUUAAGAACAGGGGAA |  | [1482-1504] 3'UTR |
| 465 | UUUCCCCUGUUCUUAAGUGUUGA | UCAACACUUAAGAACAGGGGAAA |  | [1481-1503] 3'UTR |
| 466 | CUGACCCAGAGAAUUGCUCAAGA | UCUUGAGCAAUUCUCUGGGUCAG | Chimp, Ms | [453-475] ORF |
| 467 | ACUGACCCAGAGAAUUGCUCAAG | CUUGAGCAAUUCUCUGGGUCAGU | Chimp, Ms | [452-474] ORF |
| 468 | AACUGACCCAGAGAAUUGCUCAA | UUGAGCAAUUCUCUGGGUCAGUU | Chimp, Ms | [451-473] ORF |
| 469 | GGCCUUUGGAGAAGUGAUUCAAA | UUUGAAUCACUUCUCCAAAGGCC |  | [959-981] 3'UTR |
| 470 | CCAUGGCAGUGUUAUCUCAUCUC | GAGAUGAGAUAACACUGCCAUGG |  | [1701-1723] 3'UTR |
| 471 | ACCAUGGCAGUGUUAUCUCAUCU | AGAUGAGAUAACACUGCCAUGGU |  | [1700-1722] 3'UTR |
| 472 | CACCAUGGCAGUGUUAUCUCAUC | GAUGAGAUAACACUGCCAUGGUG |  | [1699-1721] 3'UTR |
| 473 | UCACCAUGGCAGUGUUAUCUCAU | AUGAGAUAACACUGCCAUGGUGA |  | [1698-1720] 3'UTR |
| 474 | UUCACCAUGGCAGUGUUAUCUCA | UGAGAUAACACUGCCAUGGUGAA |  | [1697-1719] 3'UTR |
| 475 | CAGCUCAGGAUUUCGACUUGUUA | UAACAAGUCGAAAUCCUGAGCUG |  | [713-735] ORF |
| 476 | GACAGGAAGGUAGGAUUAAGUAG | CUACUUAAUCCUACCUUCCUGUC |  | [1280-1302] 3'UTR |
| 477 | AGACAGGAAGGUAGGAUUAAGUA | UACUUAAUCCUACCUUCCUGUCU |  | [1279-1301] 3'UTR |
| 478 | UAGACAGGAAGGUAGGAUUAAGU | ACUUAAUCCUACCUUCCUGUCUA |  | [1278-1300] 3'UTR |
| 479 | UUAGACAGGAAGGUAGGAUUAAG | CUUAAUCCUACCUUCCUGUCUAA |  | [1277-1299] 3'UTR |
| 480 | UUUAGACAGGAAGGUAGGAUUAA | UUAAUCCUACCUUCCUGUCUAAA |  | [1276-1298] 3'UTR |
| 481 | GGGUCCUAAAAAGGGAAAAUAUA | UAUAUUUUCCCUUUUUAGGACCC |  | [777-799] ORF + 3'UTR |
| 482 | AGGGUCCUAAAAAGGGAAAAUAU | AUAUUUUCCCUUUUUAGGACCCU |  | [776-798] ORF + 3'UTR |
| 483 | AAGGGUCCUAAAAAGGGAAAAUA | UAUUUUCCCUUUUUAGGACCCUU |  | [775-797] ORF + 3'UTR |
| 484 | GGAUAAGGAGCUUAUUCAGGUUU | AAACCUGAAUAAGCUCCUUAUCC |  | [2081-2103] 3'UTR |
| 485 | UGGAUAAGGAGCUUAUUCAGGUU | AACCUGAAUAAGCUCCUUAUCCA |  | [2080-2102] 3'UTR |
| 486 | GUGGAUAAGGAGCUUAUUCAGGU | ACCUGAAUAAGCUCCUUAUCCAC |  | [2079-2101] 3'UTR |
| 487 | CUUAUGGAAGGCUGUUAAAUUAA | UUAAUUUAACAGCCUUCCAUAAG |  | [2507-2529] 3'UTR |
| 488 | CGAAGGAAACAGAGCCGUUGACC | GGUCAACGGCUCUGUUUCCUUCG | Chimp | [181-203] 5'UTR |
| 489 | GCGAAGGAAACAGAGCCGUUGAC | GUCAACGGCUCUGUUUCCUUCGC | Chimp | [180-202] 5'UTR |
| 490 | CGCGAAGGAAACAGAGCCGUUGA | UCAACGGCUCUGUUUCCUUCGCG | Chimp | [179-201] 5'UTR |
| 491 | UCGCGAAGGAAACAGAGCCGUUG | CAACGGCUCUGUUUCCUUCGCGA | Chimp | [178-200] 5'UTR |
| 492 | CUCGCGAAGGAAACAGAGCCGUU | AACGGCUCUGUUUCCUUCGCGAG | Chimp | [177-199] 5'UTR |
| 493 | GUUCUAACAAACUAAACUCUUCA | UGAAGAGUUUAGUUUGUUAGAAC |  | [2248-2270] 3'UTR |

TABLE E-continued additional 23 mers

| Number | Sense siRNA | AntiSense siRNA | Other Sp | Hum-34222182 ORF: 204-785 |
|---|---|---|---|---|
| 494 | UGUUCUAACAAACUAAACUCUUC | GAAGAGUUUAGUUUGUUAGAACA | | [2247-2269] 3'UTR |
| 495 | CCUGUUCUUAAGUGUUGAAUACU | AGUAUUCAACACUUAAGAACAGG | | [1486-1508] 3'UTR |
| 496 | GGCCUUAUUUUUGUCUUAUUCC | GGAAUAAGACAAAAAAUAAGGCC | | [1950-1972] 3'UTR |
| 497 | AGGCCUUAUUUUUGUCUUAUUC | GAAUAAGACAAAAAAUAAGGCCU | | [1949-1971] 3'UTR |
| 498 | AAGGCCUUAUUUUUGUCUUAUU | AAUAAGACAAAAAAUAAGGCCUU | | [1948-1970] 3'UTR |
| 499 | AAAGGCCUUAUUUUUGUCUUAU | AUAAGACAAAAAAUAAGGCCUUU | | [1947-1969] 3'UTR |
| 500 | UAAAGGCCUUAUUUUUGUCUUA | UAAGACAAAAAAUAAGGCCUUUA | | [1946-1968] 3'UTR |
| 501 | CUCUCUGAUUCACUUAGUAAUCU | AGAUUACUAAGUGAAUCAGAGAG | | [1630-1652] 3'UTR |
| 502 | CCUCUCUGAUUCACUUAGUAAUC | GAUUACUAAGUGAAUCAGAGAGG | | [1629-1651] 3'UTR |
| 503 | CCCUCUCUGAUUCACUUAGUAAU | AUUACUAAGUGAAUCAGAGAGGG | | [1628-1650] 3'UTR |
| 504 | UCCCUCUCUGAUUCACUUAGUAA | UUACUAAGUGAAUCAGAGAGGGA | | [1627-1649] 3'UTR |
| 505 | GUCCCUCUCUGAUUCACUUAGUA | UACUAAGUGAAUCAGAGAGGGAC | | [1626-1648] 3'UTR |
| 506 | GCAUCGAUGUAGAACUGUUGUCC | GGACAACAGUUCUACAUCGAUGC | | [2424-2446] 3'UTR |
| 507 | GGCAUCGAUGUAGAACUGUUGUC | GACAACAGUUCUACAUCGAUGCC | | [2423-2445] 3'UTR |
| 508 | GGGCAUCGAUGUAGAACUGUUGU | ACAACAGUUCUACAUCGAUGCCC | | [2422-2444] 3'UTR |
| 509 | UGGGCAUCGAUGUAGAACUGUUG | CAACAGUUCUACAUCGAUGCCCA | | [2421-2443] 3'UTR |
| 510 | UUGGGCAUCGAUGUAGAACUGUU | AACAGUUCUACAUCGAUGCCCAA | | [2420-2442] 3'UTR |
| 511 | CGUCGUACCUACUUUUGAGCUUA | UAAGCUCAAAAGUAGGUACGACG | | [590-612] ORF |
| 512 | GAAUGAAACUCACCGUCCAGAUA | UAUCUGGACGGUGAGUUUCAUUC | | [1869-1891] 3'UTR |
| 513 | AGAAUGAAACUCACCGUCCAGAU | AUCUGGACGGUGAGUUUCAUUCU | | [1868-1890] 3'UTR |
| 514 | GAGAAUGAAACUCACCGUCCAGA | UCUGGACGGUGAGUUUCAUUCUC | | [1867-1889] 3'UTR |
| 515 | AGAGAAUGAAACUCACCGUCCAG | CUGGACGGUGAGUUUCAUUCUCU | | [1866-1888] 3'UTR |
| 516 | UAGAGAAUGAAACUCACCGUCCA | UGGACGGUGAGUUUCAUUCUCUA | | [1865-1887] 3'UTR |
| 517 | GUCUAUUGUUAAGCUCCAAAGGU | ACCUUUGGAGCUUAACAAUAGAC | | [2342-2364] 3'UTR |
| 518 | UGUCUAUUGUUAAGCUCCAAAGG | CCUUUGGAGCUUAACAAUAGACA | | [2341-2363] 3'UTR |
| 519 | AUGUCUAUUGUUAAGCUCCAAAG | CUUUGGAGCUUAACAAUAGACAU | | [2340-2362] 3'UTR |
| 520 | CAUGUCUAUUGUUAAGCUCCAAA | UUUGGAGCUUAACAAUAGACAUG | | [2339-2361] 3'UTR |
| 521 | GCAUGUCUAUUGUUAAGCUCCAA | UUGGAGCUUAACAAUAGACAUGC | | [2338-2360] 3'UTR |
| 522 | CAACCUCAACGAGGUAAUAUUUG | CAAAUAUUACCUCGUUGAGGUUG | Chimp | [329-351] ORF |
| 523 | CCAACCUCAACGAGGUAAUAUUU | AAAUAUUACCUCGUUGAGGUUGG | Chimp | [328-350] ORF |
| 524 | CCCAACCUCAACGAGGUAAUAUU | AAUAUUACCUCGUUGAGGUUGGG | Chimp | [327-349] ORF |
| 525 | ACCCAACCUCAACGAGGUAAUAU | AUAUUACCUCGUUGAGGUUGGGU | Chimp | [326-348] ORF |
| 526 | AACCCAACCUCAACGAGGUAAUA | UAUUACCUCGUUGAGGUUGGGUU | Chimp | [325-347] ORF |
| 527 | GGGCCAAGAUAAAUCAAUGUUGU | ACAACAUUGAUUUAUCUUGGCCC | | [2312-2334] 3'UTR |
| 528 | UGGGCCAAGAUAAAUCAAUGUUG | CAACAUUGAUUUAUCUUGGCCCA | | [2311-2333] 3'UTR |
| 529 | UUGGGCCAAGAUAAAUCAAUGUU | AACAUUGAUUUAUCUUGGCCCAA | | [2310-2332] 3'UTR |
| 530 | AUUGGGCCAAGAUAAAUCAAUGU | ACAUUGAUUUAUCUUGGCCCAAU | | [2309-2331] 3'UTR |

TABLE E-continued additional 23 mers

| Number | Sense siRNA | AntiSense siRNA | Other Sp | Hum-34222182 ORF: 204-785 |
|---|---|---|---|---|
| 531 | AAUUGGGCCAAGAUAAAUCAAUG | CAUUGAUUUAUCUUGGCCCAAUU | | [2308-2330] 3'UTR |
| 532 | GGUAGGCUUGGUAAUAGACUAUA | UAUAGUCUAUUACCAAGCCUACC | | [1098-1120] 3'UTR |
| 533 | GGUAAUAUUUGAGGAAUCAACUU | AAGUUGAUUCCUCAAAUAUUACC | Chimp | [341-363] ORF |
| 534 | AGGUAAUAUUUGAGGAAUCAACU | AGUUGAUUCCUCAAAUAUUACCU | Chimp | [340-362] ORF |
| 535 | GAGGUAAUAUUUGAGGAAUCAAC | GUUGAUUCCUCAAAUAUUACCUC | Chimp | [339-361] ORF |
| 536 | UGUAUGUAAAAGCUGGAUAGGA | UCCUAUCCAGCUUUUUACAUACA | Dog, Chimp, Ms | [551-573] ORF |
| 537 | AUGUAUGUAAAAGCUGGAUAGG | CCUAUCCAGCUUUUUACAUACAU | Dog, Chimp, Ms | [550-572] ORF |
| 538 | AAUGUAUGUAAAAGCUGGAUAG | CUAUCCAGCUUUUUACAUACAUU | Dog, Chimp, Ms | [549-571] ORF |
| 539 | AAAUGUAUGUAAAAGCUGGAUA | UAUCCAGCUUUUUACAUACAUUU | Dog, Chimp, Ms | [548-570] ORF |
| 540 | GAAACGGGUCAAUUUACGAAGUC | GACUUCGUAAAUUGACCCGUUUC | | [1806-1828] 3'UTR |
| 541 | UGAAACGGGUCAAUUUACGAAGU | ACUUCGUAAAUUGACCCGUUUCA | | [1805-1827] 3'UTR |
| 542 | UUGAAACGGGUCAAUUUACGAAG | CUUCGUAAAUUGACCCGUUUCAA | | [1804-1826] 3'UTR |
| 543 | AUUGAAACGGGUCAAUUUACGAA | UUCGUAAAUUGACCCGUUUCAAU | | [1803-1825] 3'UTR |
| 544 | UAUUGAAACGGGUCAAUUUACGA | UCGUAAAUUGACCCGUUUCAAUA | | [1802-1824] 3'UTR |
| 545 | GUUGCAACUGGCAGUUUGAGCAG | CUGCUCAAACUGCCAGUUGCAAC | Chimp | [207-229] ORF |
| 546 | GGUUGCAACUGGCAGUUUGAGCA | UGCUCAAACUGCCAGUUGCAACC | Chimp | [206-228] ORF |
| 547 | UGGUUGCAACUGGCAGUUUGAGC | GCUCAAACUGCCAGUUGCAACCA | Chimp | [205-227] ORF |
| 548 | AUGGUUGCAACUGGCAGUUUGAG | CUCAAACUGCCAGUUGCAACCAU | Chimp | [204-226] ORF |
| 549 | CAUGGUUGCAACUGGCAGUUUGA | UCAAACUGCCAGUUGCAACCAUG | Chimp | [203-225] 5'UTR + ORF |
| 550 | CCUAGAGAAUGAAACUCACCGUC | GACGGUGAGUUUCAUUCUCUAGG | | [1863-1885] 3'UTR |
| 551 | GCCUAGAGAAUGAAACUCACCGU | ACGGUGAGUUUCAUUCUCUAGGC | | [1862-1884] 3'UTR |
| 552 | AGCCUAGAGAAUGAAACUCACCG | CGGUGAGUUUCAUUCUCUAGGCU | | [1861-1883] 3'UTR |
| 553 | CAGCCUAGAGAAUGAAACUCACC | GGUGAGUUUCAUUCUCUAGGCUG | | [1860-1882] 3'UTR |
| 554 | ACAGCCUAGAGAAUGAAACUCAC | GUGAGUUUCAUUCUCUAGGCUGU | | [1859-1881] 3'UTR |
| 555 | GCCUGCUAAGUGAUUUUGACUAC | GUAGUCAAAAUCACUUAGCAGGC | Chimp | [283-305] ORF |
| 556 | AGCCUGCUAAGUGAUUUUGACUA | UAGUCAAAAUCACUUAGCAGGCU | Chimp | [282-304] ORF |
| 557 | GAGCCUGCUAAGUGAUUUUGACU | AGUCAAAAUCACUUAGCAGGCUC | Chimp | [281-303] ORF |
| 558 | AGAGCCUGCUAAGUGAUUUUGAC | GUCAAAAUCACUUAGCAGGCUCU | Chimp | [280-302] ORF |
| 559 | GAGAGCCUGCUAAGUGAUUUUGA | UCAAAAUCACUUAGCAGGCUCUC | Chimp | [279-301] ORF |
| 560 | CUAUUAGCUCCACUUCACAUGCU | AGCAUGUGAAGUGGAGCUAAUAG | | [2114-2136] 3'UTR |
| 561 | GCUAUUAGCUCCACUUCACAUGC | GCAUGUGAAGUGGAGCUAAUAGC | | [2113-2135] 3'UTR |
| 562 | AGCUAUUAGCUCCACUUCACAUG | CAUGUGAAGUGGAGCUAAUAGCU | | [2112-2134] 3'UTR |
| 563 | UAGCUAUUAGCUCCACUUCACAU | AUGUGAAGUGGAGCUAAUAGCUA | | [2111-2133] 3'UTR |
| 564 | CUAGCUAUUAGCUCCACUUCACA | UGUGAAGUGGAGCUAAUAGCUAG | | [2110-2132] 3'UTR |
| 565 | CAACAGUGAUUGAAGGGUCCUAA | UUAGGACCCUUCAAUCACUGUUG | | [763-785] ORF |
| 566 | GGGUAGUAGCUGUAUACUACCAC | GUGGUAGUAUACAGCUACUACCC | | [1772-1794] 3'UTR |
| 567 | AGGGUAGUAGCUGUAUACUACCA | UGGUAGUAUACAGCUACUACCCU | | [1771-1793] 3'UTR |

TABLE E-continued additional 23 mers

| Number | Sense siRNA | AntiSense siRNA | Other Sp | Hum-34222182 ORF: 204-785 |
|---|---|---|---|---|
| 568 | AAGGGUAGUAGCUGUAUACUACC | GGUAGUAUACAGCUACUACCCUU | | [1770-1792] 3'UTR |
| 569 | GGAUUAAGUAGGUGAGUUUAAUU | AAUUAAACUCACCUACUUAAUCC | | [1292-1314] 3'UTR |
| 570 | AGGAUUAAGUAGGUGAGUUUAAU | AUUAAACUCACCUACUUAAUCCU | | [1291-1313] 3'UTR |
| 571 | UAGGAUUAAGUAGGUGAGUUUAA | UUAAACUCACCUACUUAAUCCUA | | [1290-1312] 3'UTR |
| 572 | GUAGGAUUAAGUAGGUGAGUUUA | UAAACUCACCUACUUAAUCCUAC | | [1289-1311] 3'UTR |
| 573 | GGUAGGAUUAAGUAGGUGAGUUU | AAACUCACCUACUUAAUCCUACC | | [1288-1310] 3'UTR |
| 574 | UGUUGUUUUGCAUGUCUAUUGUU | AACAAUAGACAUGCAAAACAACA | | [2329-2351] 3'UTR |
| 575 | AUGUUGUUUUGCAUGUCUAUUGU | ACAAUAGACAUGCAAAACAACAU | | [2328-2350] 3'UTR |
| 576 | AAUGUUGUUUUGCAUGUCUAUUG | CAAUAGACAUGCAAAACAACAUU | | [2327-2349] 3'UTR |
| 577 | CAAUGUUGUUUUGCAUGUCUAUU | AAUAGACAUGCAAAACAACAUUG | | [2326-2348] 3'UTR |
| 578 | UCAAUGUUGUUUUGCAUGUCUAU | AUAGACAUGCAAAACAACAUUGA | | [2325-2347] 3'UTR |
| 579 | GUUCCUGACUCAAAUUUGAAGGG | CCCUUCAAAUUUGAGUCAGGAAC | | [1251-1273] 3'UTR |
| 580 | AGUUCCUGACUCAAAUUUGAAGG | CCUUCAAAUUUGAGUCAGGAACU | | [1250-1272] 3'UTR |
| 581 | CAGUUCCUGACUCAAAUUUGAAG | CUUCAAAUUUGAGUCAGGAACUG | | [1249-1271] 3'UTR |
| 582 | CCAGUUCCUGACUCAAAUUUGAA | UUCAAAUUUGAGUCAGGAACUGG | | [1248-1270] 3'UTR |
| 583 | ACCAGUUCCUGACUCAAAUUUGA | UCAAAUUUGAGUCAGGAACUGGU | | [1247-1269] 3'UTR |
| 584 | AGUAACCACGGUGUUGUUUUAGA | UCUAAAACAACACCGUGGUUACU | | [1441-1463] 3'UTR |
| 585 | CAGUAACCACGGUGUUGUUUUAG | CUAAAACAACACCGUGGUUACUG | | [1440-1462] 3'UTR |
| 586 | UCAGUAACCACGGUGUUGUUUUA | UAAAACAACACCGUGGUUACUGA | | [1439-1461] 3'UTR |
| 587 | UUCAGUAACCACGGUGUUGUUUU | AAAACAACACCGUGGUUACUGAA | | [1438-1460] 3'UTR |
| 588 | UUUCAGUAACCACGGUGUUGUUU | AAACAACACCGUGGUUACUGAAA | | [1437-1459] 3'UTR |
| 589 | AUUUCAGUAACCACGGUGUUGUU | AACAACACCGUGGUUACUGAAAU | | [1436-1458] 3'UTR |
| 590 | AGAUUUUUUCCACCUUGGAUACC | GGUAUCCAAGGUGGAAAAAAUCU | | [1907-1929] 3'UTR |
| 591 | CAGAUUUUUUCCACCUUGGAUAC | GUAUCCAAGGUGGAAAAAAUCUG | | [1906-1928] 3'UTR |
| 592 | CCAGAUUUUUUCCACCUUGGAUA | UAUCCAAGGUGGAAAAAAUCUGG | | [1905-1927] 3'UTR |
| 593 | CCCAGAUUUUUUCCACCUUGGAU | AUCCAAGGUGGAAAAAAUCUGGG | | [1904-1926] 3'UTR |
| 594 | ACCCAGAUUUUUUCCACCUUGGA | UCCAAGGUGGAAAAAAUCUGGGU | | [1903-1925] 3'UTR |
| 595 | CAGAUUUGCCUAUUUUGAUUUUC | GAAAAUCAAAAUAGGCAAAUCUG | | [1126-1148] 3'UTR |
| 596 | UUUAUAGUACAGCCUAGAGAAUG | CAUUCUCUAGGCUGUACUAUAAA | | [1851-1873] 3'UTR |
| 597 | GUUUAUAGUACAGCCUAGAGAAU | AUUCUCUAGGCUGUACUAUAAAC | | [1850-1872] 3'UTR |
| 598 | GGUUUAUAGUACAGCCUAGAGAA | UUCUCUAGGCUGUACUAUAAACC | | [1849-1871] 3'UTR |
| 599 | GCGAGGUUGUGUUAUGCACGUGA | UCACGUGCAUAACACAACCUCGC | Ms | [512-534] ORF |
| 600 | GAUACCUGUCACUAGGGAAUAU | AUUAUUCCCUAGUGACAGGUAUC | | [1924-1946] 3'UTR |
| 601 | GGAUACCUGUCACUAGGGAAUAA | UUAUUCCCUAGUGACAGGUAUCC | | [1923-1945] 3'UTR |
| 602 | UGGAUACCUGUCACUAGGGAAUA | UAUUCCCUAGUGACAGGUAUCCA | | [1922-1944] 3'UTR |
| 603 | UUGGAUACCUGUCACUAGGGAAU | AUUCCCUAGUGACAGGUAUCCAA | | [1921-1943] 3'UTR |
| 604 | CUUGGAUACCUGUCACUAGGGAA | UUCCCUAGUGACAGGUAUCCAAG | | [1920-1942] 3'UTR |

TABLE E-continued additional 23 mers

| Number | Sense siRNA | AntiSense siRNA | Other Sp | Hum-34222182 ORF: 204-785 |
|---|---|---|---|---|
| 605 | UAAAUGAGAAAUAUUACGGCAAU | AUUGCCGUAAUAUUUCUCAUUUA | | [1337-1359] 3'UTR |
| 606 | CCUAUCAAAACUUCCAAAAGCCC | GGGCUUUUGGAAGUUUUGAUAGG | | [1219-1241] 3'UTR |
| 607 | GCGUAGGGACAGAUGUAUUCAUC | GAUGAAUACAUCUGUCCCUACGC | | [2145-2167] 3'UTR |
| 608 | GGCGUAGGGACAGAUGUAUUCAU | AUGAAUACAUCUGUCCCUACGCC | | [2144-2166] 3'UTR |
| 609 | CGGCGUAGGGACAGAUGUAUUCA | UGAAUACAUCUGUCCCUACGCCG | | [2143-2165] 3'UTR |
| 610 | CCGGCGUAGGGACAGAUGUAUUC | GAAUACAUCUGUCCCUACGCCGG | | [2142-2164] 3'UTR |
| 611 | ACCGGCGUAGGGACAGAUGUAUU | AAUACAUCUGUCCCUACGCCGGU | | [2141-2163] 3'UTR |
| 612 | GAUACUAUAAGUGACCUAAAAUG | CAUUUUAGGUCACUUAUAGUAUC | | [2204-2226] 3'UTR |
| 613 | UGAUACUAUAAGUGACCUAAAAU | AUUUUAGGUCACUUAUAGUAUCA | | [2203-2225] 3'UTR |
| 614 | CUGAUACUAUAAGUGACCUAAAA | UUUUAGGUCACUUAUAGUAUCAG | | [2202-2224] 3'UTR |
| 615 | ACUGAUACUAUAAGUGACCUAAA | UUUAGGUCACUUAUAGUAUCAGU | | [2201-2223] 3'UTR |
| 616 | UACUGAUACUAUAAGUGACCUAA | UUAGGUCACUUAUAGUAUCAGUA | | [2200-2222] 3'UTR |
| 617 | CGAAGUCUGCAUUGGCUAUGGAG | CUCCAUAGCCAAUGCAGACUUCG | | [1822-1844] 3'UTR |
| 618 | ACGAAGUCUGCAUUGGCUAUGGA | UCCAUAGCCAAUGCAGACUUCGU | | [1821-1843] 3'UTR |
| 619 | UACGAAGUCUGCAUUGGCUAUGG | CCAUAGCCAAUGCAGACUUCGUA | | [1820-1842] 3'UTR |
| 620 | UUACGAAGUCUGCAUUGGCUAUG | CAUAGCCAAUGCAGACUUCGUAA | | [1819-1841] 3'UTR |
| 621 | UUUACGAAGUCUGCAUUGGCUAU | AUAGCCAAUGCAGACUUCGUAAA | | [1818-1840] 3'UTR |
| 622 | GGAUAGGAUUGUGUGUGAUUCUA | UAGAAUCACACACAAUCCUAUCC | Chin, GP, Chimp, Rat | [566-588] ORF |
| 623 | UGGAUAGGAUUGUGUGUGAUUCU | AGAAUCACACACAAUCCUAUCCA | Chin, GP, Chimp, Rat | [565-587] ORF |
| 624 | CUGGAUAGGAUUGUGUGUGAUUC | GAAUCACACACAAUCCUAUCCAG | Chin, GP, Chimp, Rat | [564-586] ORF |
| 625 | GCUGGAUAGGAUUGUGUGUGAUU | AAUCACACACAAUCCUAUCCAGC | Chin, GP, Chimp, Rat | [563-585] ORF |
| 626 | AGCUGGAUAGGAUUGUGUGUGAU | AUCACACACAAUCCUAUCCAGCU | Chin, GP, Chimp, Rat | [562-584] ORF |
| 627 | UGGCCUUUGGAGAAGUGAUUCAA | UUGAAUCACUUCUCCAAAGGCCA | | [958-980] 3'UTR |
| 628 | CUGGCCUUUGGAGAAGUGAUUCA | UGAAUCACUUCUCCAAAGGCCAG | | [957-979] 3'UTR |
| 629 | UCUGGCCUUUGGAGAAGUGAUUC | GAAUCACUUCUCCAAAGGCCAGA | | [956-978] 3'UTR |
| 630 | UUCUGGCCUUUGGAGAAGUGAUU | AAUCACUUCUCCAAAGGCCAGAA | | [955-977] 3'UTR |
| 631 | AUAGGUAAGCAAAAGUAGAAGCC | GGCUUCUACUUUUGCUUACCUAU | | [1037-1059] 3'UTR |
| 632 | AAUAGGUAAGCAAAAGUAGAAGC | GCUUCUACUUUUGCUUACCUAUU | | [1036-1058] 3'UTR |
| 633 | AGGUAGGAUUAAGUAGGUGAGUU | AACUCACCUACUUAAUCCUACCU | | [1287-1309] 3'UTR |
| 634 | AAGGUAGGAUUAAGUAGGUGAGU | ACUCACCUACUUAAUCCUACCUU | | [1286-1308] 3'UTR |
| 635 | GAAGGUAGGAUUAAGUAGGUGAG | CUCACCUACUUAAUCCUACCUUC | | [1285-1307] 3'UTR |
| 636 | GGAAGGUAGGAUUAAGUAGGUGA | UCACCUACUUAAUCCUACCUUCC | | [1284-1306] 3'UTR |
| 637 | GAUUAAGUAGGUGAGUUUAAUUA | UAAUUAAACUCACCUACUUAAUC | | [1293-1315] 3'UTR |
| 638 | AGGAAGGUAGGAUUAAGUAGGUG | CACCUACUUAAUCCUACCUUCCU | | [1283-1305] 3'UTR |
| 639 | CAGGAAGGUAGGAUUAAGUAGGU | ACCUACUUAAUCCUACCUUCCUG | | [1282-1304] 3'UTR |
| 640 | ACAGGAAGGUAGGAUUAAGUAGG | CCUACUUAAUCCUACCUUCCUGU | | [1281-1303] 3'UTR |
| 641 | AACAGGUGUGAUCCUGUUACUGA | UCAGUAACAGGAUCACACCUGUU | | [2183-2205] 3'UTR |

TABLE E-continued additional 23 mers

| Number | Sense siRNA | AntiSense siRNA | Other Sp | Hum-34222182 ORF: 204-785 |
|---|---|---|---|---|
| 642 | CAUGGACUAGCUUCAGGGACUUU | AAAGUCCCUGAAGCUAGUCCAUG | Dog, Chimp | [640-662] ORF |
| 643 | UCAUGGACUAGCUUCAGGGACUU | AAGUCCCUGAAGCUAGUCCAUGA | Dog, Chimp | [639-661] ORF |
| 644 | CUCAUGGACUAGCUUCAGGGACU | AGUCCCUGAAGCUAGUCCAUGAG | Dog, Chimp | [638-660] ORF |
| 645 | GCUCAUGGACUAGCUUCAGGGAC | GUCCCUGAAGCUAGUCCAUGAGC | Dog, Chimp | [637-659] ORF |
| 646 | UGCUCAUGGACUAGCUUCAGGGA | UCCCUGAAGCUAGUCCAUGAGCA | Dog, Chimp | [636-658] ORF |
| 647 | AUUUGAAGGGUUUUUAGACAGGA | UCCUGUCUAAAAACCCUUCAAAU |  | [1264-1286] 3'UTR |
| 648 | ACAACAGUGAUUGAAGGGUCCUA | UAGGACCCUUCAAUCACUGUUGU |  | [762-784] ORF |
| 649 | UGUACAGAAUUGAAUGGGAUGGA | UCCAUCCCAUUCAAUUCUGUACA |  | [1014-1036] 3'UTR |
| 650 | UUGUACAGAAUUGAAUGGGAUGG | CCAUCCCAUUCAAUUCUGUACAA |  | [1013-1035] 3'UTR |
| 651 | UUUGUACAGAAUUGAAUGGGAUG | CAUCCCAUUCAAUUCUGUACAAA |  | [1012-1034] 3'UTR |
| 652 | UUUUGUACAGAAUUGAAUGGGAU | AUCCCAUUCAAUUCUGUACAAAA |  | [1011-1033] 3'UTR |
| 653 | UUUUUGUACAGAAUUGAAUGGGA | UCCCAUUCAAUUCUGUACAAAAA |  | [1010-1032] 3'UTR |
| 654 | CUCAACGAGGUAAUAUUUGAGGA | UCCUCAAAUAUUACCUCGUUGAG | Chimp | [333-355] ORF |
| 655 | CCUCAACGAGGUAAUAUUUGAGG | CCUCAAAUAUUACCUCGUUGAGG | Chimp | [332-354] ORF |
| 656 | ACCUCAACGAGGUAAUAUUUGAG | CUCAAAUAUUACCUCGUUGAGGU | Chimp | [331-353] ORF |
| 657 | AACCUCAACGAGGUAAUAUUUGA | UCAAAUAUUACCUCGUUGAGGUU | Chimp | [330-352] ORF |
| 658 | UCUCUGGGCUUUUCUGGGAAUUG | CAAUUCCCAGAAAAGCCCAGAGA |  | [1720-1742] 3'UTR |
| 659 | AUCUCUGGGCUUUUCUGGGAAUU | AAUUCCCAGAAAAGCCCAGAGAU |  | [1719-1741] 3'UTR |
| 660 | CAUCUCUGGGCUUUUCUGGGAAU | AUUCCCAGAAAAGCCCAGAGAUG |  | [1718-1740] 3'UTR |
| 661 | UCAUCUCUGGGCUUUUCUGGGAA | UUCCCAGAAAAGCCCAGAGAUGA |  | [1717-1739] 3'UTR |
| 662 | GGCUUGCGAGGUUGUGUUAUGCA | UGCAUAACACAACCUCGCAAGCC | Chimp | [507-529] ORF |
| 663 | CGGCUUGCGAGGUUGUGUUAUGC | GCAUAACACAACCUCGCAAGCCG | Chimp | [506-528] ORF |
| 664 | GCGGCUUGCGAGGUUGUGUUAUG | CAUAACACAACCUCGCAAGCCGC | Chimp | [505-527] ORF |
| 665 | UGCGGCUUGCGAGGUUGUGUUAU | AUAACACAACCUCGCAAGCCGCA | Chimp | [504-526] ORF |
| 666 | CUGCGGCUUGCGAGGUUGUGUUA | UAACACAACCUCGCAAGCCGCAG | Chimp | [503-525] ORF |
| 667 | UACGGCAAUAAUGGAACUGCUUC | GAAGCAGUUCCAUUAUUGCCGUA |  | [1351-1373] 3'UTR |
| 668 | UUACGGCAAUAAUGGAACUGCUU | AAGCAGUUCCAUUAUUGCCGUAA |  | [1350-1372] 3'UTR |
| 669 | AUUACGGCAAUAAUGGAACUGCU | AGCAGUUCCAUUAUUGCCGUAAU |  | [1349-1371] 3'UTR |
| 670 | CUUUACUCACUGAUUGGAACAAC | GUUGUUCCAAUCAGUGAGUAAAG |  | [744-766] ORF |
| 671 | ACUUUACUCACUGAUUGGAACAA | UUGUUCCAAUCAGUGAGUAAAGU |  | [743-765] ORF |
| 672 | AACUUUACUCACUGAUUGGAACA | UGUUCCAAUCAGUGAGUAAAGUU |  | [742-764] ORF |
| 673 | AAACUUUACUCACUGAUUGGAAC | GUUCCAAUCAGUGAGUAAAGUUU |  | [741-763] ORF |
| 674 | AAAACUUUACUCACUGAUUGGAA | UUCCAAUCAGUGAGUAAAGUUUU |  | [740-762] ORF |
| 675 | UUUUAGACAGGAAGGUAGGAUUA | UAAUCCUACCUUCCUGUCUAAAA |  | [1275-1297] 3'UTR |
| 676 | UGACUUCCUCACUCUAAUGUUUU | AAAACAUUAGAGUGAGGAAGUCA |  | [1386-1408] 3'UTR |
| 677 | GGACUUUUUCUUUAGUAGAGGUC | GACCUCUACUAAAGAAAAGUCC |  | [656-678] ORF |
| 678 | GGGACUUUUUCUUUAGUAGAGGU | ACCUCUACUAAAGAAAAGUCCC |  | [655-677] ORF |

TABLE E-continued additional 23 mers

| Number | Sense siRNA | AntiSense siRNA | Other Sp | Hum-34222182 ORF: 204-785 |
|---|---|---|---|---|
| 679 | AGGGACUUUUUCUUUAGUAGAGG | CCUCUACUAAAGAAAAAGUCCCU | | [654-676] ORF |
| 680 | CAGGGACUUUUUCUUUAGUAGAG | CUCUACUAAAGAAAAAGUCCCUG | | [653-675] ORF |
| 681 | UCAGGGACUUUUUCUUUAGUAGA | UCUACUAAAGAAAAAGUCCCUGA | | [652-674] ORF |
| 682 | CUCUGAUUCACUUAGUAAUCUAU | AUAGAUUACUAAGUGAAUCAGAG | | [1632-1654] 3'UTR |
| 683 | UCUCUGAUUCACUUAGUAAUCUA | UAGAUUACUAAGUGAAUCAGAGA | | [1631-1653] 3'UTR |
| 684 | GGGAAUAAUAAAGGCCUUAUUUU | AAAAUAAGGCCUUUAUUAUUCCC | | [1938-1960] 3'UTR |
| 685 | AGGGAAUAAUAAAGGCCUUAUUU | AAAUAAGGCCUUUAUUAUUCCCU | | [1937-1959] 3'UTR |
| 686 | UAGGGAAUAAUAAAGGCCUUAUU | AAUAAGGCCUUUAUUAUUCCCUA | | [1936-1958] 3'UTR |
| 687 | CUAGGGAAUAAUAAAGGCCUUAU | AUAAGGCCUUUAUUAUUCCCUAG | | [1935-1957] 3'UTR |
| 688 | ACUAGGGAAUAAUAAAGGCCUUA | UAAGGCCUUUAUUAUUCCCUAGU | | [1934-1956] 3'UTR |
| 689 | AAUACCUGUGAGGAUAGGAAAUU | AAUUUCCUAUCCUCACAGGUAUU | | [1589-1611] 3'UTR |
| 690 | GAAUACCUGUGAGGAUAGGAAAU | AUUUCCUAUCCUCACAGGUAUUC | | [1588-1610] 3'UTR |
| 691 | UGAAUACCUGUGAGGAUAGGAAA | UUUCCUAUCCUCACAGGUAUUCA | | [1587-1609] 3'UTR |
| 692 | CCUUGGAUACCUGUCACUAGGGA | UCCCUAGUGACAGGUAUCCAAGG | | [1919-1941] 3'UTR |
| 693 | CUAGCUUCAGGGACUUUUUCUUU | AAAGAAAAAGUCCCUGAAGCUAG | Chimp | [646-668] ORF |
| 694 | ACUAGCUUCAGGGACUUUUUCUU | AAGAAAAAGUCCCUGAAGCUAGU | Chimp | [645-667] ORF |
| 695 | GACUAGCUUCAGGGACUUUUUCU | AGAAAAAGUCCCUGAAGCUAGUC | Chimp | [644-666] ORF |
| 696 | GGACUAGCUUCAGGGACUUUUUC | GAAAAAGUCCCUGAAGCUAGUCC | Chimp | [643-665] ORF |
| 697 | UGGACUAGCUUCAGGGACUUUUU | AAAAAGUCCCUGAAGCUAGUCCA | Chimp | [642-664] ORF |
| 698 | AAAGAUACUACAAAGCCAAUCUU | AAGAUUGGCUUUGUAGUAUCUUU | | [2280-2302] 3'UTR |
| 699 | AAGCUGGAUAGGAUUGUGUGUGA | UCACACACAAUCCUAUCCAGCUU | Chin, GP, Chimp, Rat | [561-583] ORF |
| 700 | UGUGGUGCCAUUUCAGUAACCAC | GUGGUUACUGAAAUGGCACCACA | | [1427-1449] 3'UTR |
| 701 | UUGUGGUGCCAUUUCAGUAACCA | UGGUUACUGAAAUGGCACCACAA | | [1426-1448] 3'UTR |
| 702 | CUUGUGGUGCCAUUUCAGUAACC | GGUUACUGAAAUGGCACCACAAG | | [1425-1447] 3'UTR |
| 703 | GCUUGUGGUGCCAUUUCAGUAAC | GUUACUGAAAUGGCACCACAAGC | | [1424-1446] 3'UTR |
| 704 | AGCUUGUGGUGCCAUUUCAGUAA | UUACUGAAAUGGCACCACAAGCU | | [1423-1445] 3'UTR |
| 705 | CUUUAUAGAAUUGGGCCAAGAUA | UAUCUUGGCCCAAUUCUAUAAAG | | [2300-2322] 3'UTR |
| 706 | GUUUCAGGUAGGCUUGGUAAUAG | CUAUUACCAAGCCUACCUGAAAC | | [1092-1114] 3'UTR |
| 707 | GGUUUCAGGUAGGCUUGGUAAUA | UAUUACCAAGCCUACCUGAAACC | | [1091-1113] 3'UTR |
| 708 | UGGUUUCAGGUAGGCUUGGUAAU | AUUACCAAGCCUACCUGAAACCA | | [1090-1112] 3'UTR |
| 709 | UUGGUUUCAGGUAGGCUUGGUAA | UUACCAAGCCUACCUGAAACCAA | | [1089-1111] 3'UTR |
| 710 | UUUGGUUUCAGGUAGGCUUGGUA | UACCAAGCCUACCUGAAACCAAA | | [1088-1110] 3'UTR |
| 711 | UGGGUCGUGGAUAAGGAGCUAUU | AUAAGCUCCUUAUCCACGACCCA | | [2073-2095] 3'UTR |
| 712 | GUGGGUCGUGGAUAAGGAGCUUA | UAAGCUCCUUAUCCACGACCCAC | | [2072-2094] 3'UTR |
| 713 | AAUGGUGAUGGCUUAUGGAAGGC | GCCUUCCAUAAGCCAUCACCAUU | | [2496-2518] 3'UTR |
| 714 | AAAUGGUGAUGGCUUAUGGAAGG | CCUUCCAUAAGCCAUCACCAUUU | | [2495-2517] 3'UTR |
| 715 | AAAAUGGUGAUGGCUUAUGGAAG | CUUCCAUAAGCCAUCACCAUUUU | | [2494-2516] 3'UTR |

TABLE E-continued additional 23 mers

| Number | Sense siRNA | AntiSense siRNA | Other Sp | Hum-34222182 ORF: 204-785 |
|---|---|---|---|---|
| 716 | CAAAAUGGUGAUGGCUUAUGGAA | UUCCAUAAGCCAUCACCAUUUUG | | [2493-2515] 3'UTR |
| 717 | AAGCUUGUGGUGCCAUUUCAGUA | UACUGAAAUGGCACCACAAGCUU | | [1422-1444] 3'UTR |
| 718 | AAAGCUUGUGGUGCCAUUUCAGU | ACUGAAAUGGCACCACAAGCUUU | | [1421-1443] 3'UTR |
| 719 | AAAAGCUUGUGGUGCCAUUUCAG | CUGAAAUGGCACCACAAGCUUUU | | [1420-1442] 3'UTR |
| 720 | UAGGUAAGCAAAAGUAGAAGCCC | GGGCUUCUACUUUUGCUUACCUA | | [1038-1060] 3'UTR |
| 721 | UGAUUUUCUGGCCUUUGGAGAAG | CUUCUCCAAAGGCCAGAAAAUCA | | [950-972] 3'UTR |
| 722 | CUGAUUUUCUGGCCUUUGGAGAA | UUCUCCAAAGGCCAGAAAAUCAG | | [949-971] 3'UTR |
| 723 | GCUGAUUUUCUGGCCUUUGGAGA | UCUCCAAAGGCCAGAAAAUCAGC | | [948-970] 3'UTR |
| 724 | AGGCUGAUUUUCUGGCCUUUGGA | UCCAAAGGCCAGAAAAUCAGCCU | | [946-968] 3'UTR |
| 725 | AGGCUUCUUGGGCAUCGAUGUAG | CUACAUCGAUGCCCAAGAAGCCU | | [2413-2435] 3'UTR |
| 726 | AAGGCUUCUUGGGCAUCGAUGUA | UACAUCGAUGCCCAAGAAGCCUU | | [2412-2434] 3'UTR |
| 727 | CAAGGCUUCUUGGGCAUCGAUGU | ACAUCGAUGCCCAAGAAGCCUUG | | [2411-2433] 3'UTR |
| 728 | CCGUCCAGAUAACCAUGCAUCGA | UGCAUGCAUGGUUAUCUGGACGG | | [1881-1903] 3'UTR |
| 729 | ACCGUCCAGAUAACCAUGCAUGC | GCAUGCAUGGUUAUCUGGACGGU | | [1880-1902] 3'UTR |
| 730 | CACCGUCCAGAUAACCAUGCAUG | CAUGCAUGGUUAUCUGGACGGUG | | [1879-1901] 3'UTR |
| 731 | UCACCGUCCAGAUAACCAUGCAU | AUGCAUGGUUAUCUGGACGGUGA | | [1878-1900] 3'UTR |
| 732 | CUCACCGUCCAGAUAACCAUGCA | UGCAUGGUUAUCUGGACGGUGAG | | [1877-1899] 3'UTR |
| 733 | AACCAUGCAUGCACCCAGAUUUU | AAAAUCUGGGUGCAUGCAUGGUU | | [1891-1913] 3'UTR |
| 734 | UAACCAUGCAUGCACCCAGAUUU | AAAUCUGGGUGCAUGCAUGGUUA | | [1890-1912] 3'UTR |
| 735 | AUAACCAUGCAUGCACCCAGAUU | AAUCUGGGUGCAUGCAUGGUUAU | | [1889-1911] 3'UTR |
| 736 | GAUAACCAUGCAUGCACCCAGAU | AUCUGGGUGCAUGCAUGGUUAUC | | [1888-1910] 3'UTR |
| 737 | AGAUAACCAUGCAUGCACCCAGA | UCUGGGUGCAUGCAUGGUUAUCU | | [1887-1909] 3'UTR |
| 738 | GAAUUGGGCCAAGAUAAAUCAAU | AUUGAUUUAUCUUGGCCCAAUUC | | [2307-2329] 3'UTR |
| 739 | GUGAGGAUAGGAAAUUAGUUCUG | CAGAACUAAUUUCCUAUCCUCAC | | [1596-1618] 3'UTR |
| 740 | UGUGAGGAUAGGAAAUUAGUUCU | AGAACUAAUUUCCUAUCCUCACA | | [1595-1617] 3'UTR |
| 741 | GAUUUUUUCCACCUUGGAUACCU | AGGUAUCCAAGGUGGAAAAAAUC | | [1908-1930] 3'UTR |
| 742 | GAAGCCCAUUUGAGUUUUACAUU | AAUGUAAAACUCAAAUGGGCUUC | | [1054-1076] 3'UTR |
| 743 | AGAAGCCCAUUUGAGUUUUACAU | AUGUAAAACUCAAAUGGGCUUCU | | [1053-1075] 3'UTR |
| 744 | UAGAAGCCCAUUUGAGUUUUACA | UGUAAAACUCAAAUGGGCUUCUA | | [1052-1074] 3'UTR |
| 745 | GUAGAAGCCCAUUUGAGUUUUAC | GUAAAACUCAAAUGGGCUUCUAC | | [1051-1073] 3'UTR |
| 746 | AGUAGAAGCCCAUUUGAGUUUUA | UAAAACUCAAAUGGGCUUCUACU | | [1050-1072] 3'UTR |
| 747 | AGCAGGAGAACUGCUCAUGGACU | AGUCCAUGAGCAGUUCUCCUGCU | Dog, Chimp | [625-647] ORF |
| 748 | AAGCAGGAGAACUGCUCAUGGAC | GUCCAUGAGCAGUUCUCCUGCUU | Dog, Chimp | [624-646] ORF |
| 749 | UAAGCAGGAGAACUGCUCAUGGA | UCCAUGAGCAGUUCUCCUGCUUA | Dog, Chimp | [623-645] ORF |
| 750 | GCAUGCACCCAGAUUUUUUCCAC | GUGGAAAAAAUCUGGGUGCAUGC | | [1897-1919] 3'UTR |
| 751 | UGCAUGCACCCAGAUUUUUUCCA | UGGAAAAAAUCUGGGUGCAUGCA | | [1896-1918] 3'UTR |
| 752 | AUGCAUGCACCCAGAUUUUUUCC | GGAAAAAAUCUGGGUGCAUGCAU | | [1895-1917] 3'UTR |

TABLE E-continued additional 23 mers

| Number | Sense siRNA | AntiSense siRNA | Other Sp | Hum-34222182 ORF: 204-785 |
|---|---|---|---|---|
| 753 | CAUGCAUGCACCCAGAUUUUUC | GAAAAAUCUGGGUGCAUGCAUG | | [1894-1916] 3'UTR |
| 754 | CCAUGCAUGCACCCAGAUUUUU | AAAAAUCUGGGUGCAUGCAUGG | | [1893-1915] 3'UTR |
| 755 | CCUGCUAAGUGAUUUGACUACU | AGUAGUCAAAUCACUUAGCAGG | Chimp | [284-306] ORF |
| 756 | UACUGGGAUUAUGUUGUUCCUGA | UCAGGAACAACAUAAUCCCAGUA | Chimp | [303-325] ORF |
| 757 | CUCUUGCCUGUUAUGCUUACAAA | UUUGUAAGCAUAACAGGCAAGAG | | [2474-2496] 3'UTR |
| 758 | CCACCUUGGAUACCUGUCACUAG | CUAGUGACAGGUAUCCAAGGUGG | | [1916-1938] 3'UTR |
| 759 | UCCACCUUGGAUACCUGUCACUA | UAGUGACAGGUAUCCAAGGUGGA | | [1915-1937] 3'UTR |
| 760 | UUCCACCUUGGAUACCUGUCACU | AGUGACAGGUAUCCAAGGUGGAA | | [1914-1936] 3'UTR |
| 761 | UUUCCACCUUGGAUACCUGUCAC | GUGACAGGUAUCCAAGGUGGAAA | | [1913-1935] 3'UTR |
| 762 | UUUUCCACCUUGGAUACCUGUCA | UGACAGGUAUCCAAGGUGGAAAA | | [1912-1934] 3'UTR |
| 763 | UUUCUGGCCUUUGGAGAAGUGAU | AUCACUUCUCCAAAGGCCAGAAA | | [954-976] 3'UTR |
| 764 | UUCUGCAUAGAUCCCAUUUUUGU | ACAAAAUGGGAUCUAUGCAGAA | | [994-1016] 3'UTR |
| 765 | UUUCUGCAUAGAUCCCAUUUUUG | CAAAAUGGGAUCUAUGCAGAAA | | [993-1015] 3'UTR |
| 766 | UUUUCUGCAUAGAUCCCAUUUUU | AAAAUGGGAUCUAUGCAGAAAA | | [992-1014] 3'UTR |
| 767 | GAACCCAACCUCAACGAGGUAAU | AUUACCUCGUUGAGGUUGGGUUC | Chimp | [324-346] ORF |
| 768 | AGAAACUGACCCAGAGAAUUGCU | AGCAAUUCUCUGGGUCAGUUUCU | Chin, GP, Chimp, Rat, Ms | [448-470] ORF |
| 769 | UUCUUGGUGACUUCCUCACUCUA | UAGAGUGAGGAAGUCACCAAGAA | | [1379-1401] 3'UTR |
| 770 | CACUAGGGAAUAAUAAAGGCCUU | AAGGCCUUUAUUAUUCCCUAGUG | | [1933-1955] 3'UTR |
| 771 | CCUGUUAUGCUUACAAAAUGGUG | CACCAUUUUGUAAGCAUAACAGG | | [2480-2502] 3'UTR |
| 772 | AAAGUAGAAGCCCAUUUGAGUUU | AAACUCAAAUGGGCUUCUACUUU | | [1048-1070] 3'UTR |
| 773 | AAAAGUAGAAGCCCAUUUGAGUU | AACUCAAAUGGGCUUCUACUUUU | | [1047-1069] 3'UTR |
| 774 | CAAAAGUAGAAGCCCAUUUGAGU | ACUCAAAUGGGCUUCUACUUUUG | | [1046-1068] 3'UTR |
| 775 | GCAAAAGUAGAAGCCCAUUUGAG | CUCAAAUGGGCUUCUACUUUUGC | | [1045-1067] 3'UTR |
| 776 | AGCAAAAGUAGAAGCCCAUUUGA | UCAAAUGGGCUUCUACUUUUGCU | | [1044-1066] 3'UTR |
| 777 | GAUUUUGACUACUGGGAUUAUGU | ACAUAAUCCCAGUAGUCAAAAUC | Dog, Chimp | [294-316] ORF |
| 778 | UGAUUUUGACUACUGGGAUUAUG | CAUAAUCCCAGUAGUCAAAAUCA | Dog, Chimp | [293-315] ORF |
| 779 | GUGAUUUUGACUACUGGGAUUAU | AUAAUCCCAGUAGUCAAAAUCAC | Dog, Chimp | [292-314] ORF |
| 780 | AGUGAUUUUGACUACUGGGAUUA | UAAUCCCAGUAGUCAAAAUCACU | Dog, Chimp | [291-313] ORF |
| 781 | AAGUGAUUUUGACUACUGGGAUU | AAUCCCAGUAGUCAAAAUCACUU | Dog, Chimp | [290-312] ORF |
| 782 | UGAUGGCUUAUGGAAGGCUGUUA | UAACAGCCUUCCAUAAGCCAUCA | | [2501-2523] 3'UTR |
| 783 | UGUUGUCCUUUUUCCACUAACAG | CUGUUAGUGGAAAAGGACAACA | | [2439-2461] 3'UTR |
| 784 | CUGUUGUCCUUUUUCCACUAACA | UGUUAGUGGAAAAGGACAACAG | | [2438-2460] 3'UTR |
| 785 | ACUGUUGUCCUUUUUCCACUAAC | GUUAGUGGAAAAGGACAACAGU | | [2437-2459] 3'UTR |
| 786 | AACUGUUGUCCUUUUUCCACUAA | UUAGUGGAAAAGGACAACAGUU | | [2436-2458] 3'UTR |
| 787 | GAACUGUUGUCCUUUUUCCACUA | UAGUGGAAAAGGACAACAGUUC | | [2435-2457] 3'UTR |
| 788 | GACCGGCGUAGGGACAGAUGUAU | AUACAUCUGUCCCUACGCCGGUC | | [2140-2162] 3'UTR |
| 789 | AGUGUAGAUUUUCUGCAUAGAUC | GAUCUAUGCAGAAAAUCUACACU | | [984-1006] 3'UTR |

TABLE E-continued additional 23 mers

| Number | Sense siRNA | AntiSense siRNA | Other Sp | Hum-34222182 ORF: 204-785 |
|---|---|---|---|---|
| 790 | UAGUGUAGAUUUUCUGCAUAGAU | AUCUAUGCAGAAAAUCUACACUA | | [983-1005] 3'UTR |
| 791 | AUAGUGUAGAUUUUCUGCAUAGA | UCUAUGCAGAAAAUCUACACUAU | | [982-1004] 3'UTR |
| 792 | AAUAGUGUAGAUUUUCUGCAUAG | CUAUGCAGAAAAUCUACACUAUU | | [981-1003] 3'UTR |
| 793 | AAAUAGUGUAGAUUUUCUGCAUA | UAUGCAGAAAAUCUACACUAUUU | | [980-1002] 3'UTR |
| 794 | ACCUUGGAUACCUGUCACUAGGG | CCCUAGUGACAGGUAUCCAAGGU | | [1918-1940] 3'UTR |
| 795 | CACCUUGGAUACCUGUCACUAGG | CCUAGUGACAGGUAUCCAAGGUG | | [1917-1939] 3'UTR |
| 796 | CACCCAGAUUUUUCCACCUUGG | CCAAGGUGGAAAAAUCUGGGUG | | [1902-1924] 3'UTR |
| 797 | GCACCCAGAUUUUUCCACCUUG | CAAGGUGGAAAAAUCUGGGUGC | | [1901-1923] 3'UTR |
| 798 | GAUAGGAAAUUAGUUCUGAGAUC | GAUCUCAGAACUAAUUUCCUAUC | | [1601-1623] 3'UTR |
| 799 | GGAUAGGAAAUUAGUUCUGAGAU | AUCUCAGAACUAAUUUCCUAUCC | | [1600-1622] 3'UTR |
| 800 | AGGAUAGGAAAUUAGUUCUGAGA | UCUCAGAACUAAUUUCCUAUCCU | | [1599-1621] 3'UTR |
| 801 | GAGGAUAGGAAAUUAGUUCUGAG | CUCAGAACUAAUUUCCUAUCCUC | | [1598-1620] 3'UTR |
| 802 | UGAGGAUAGGAAAUUAGUUCUGA | UCAGAACUAAUUUCCUAUCCUCA | | [1597-1619] 3'UTR |
| 803 | ACCUGCCCUAAAUAAGAAACCCC | GGGGUUUCUUAUUUAGGGCAGGU | | [870-892] 3'UTR |
| 804 | CAGCUAAAGUCAUUUGUAGUUUG | CAAACUACAAAUGACUUUAGCUG | | [843-865] 3'UTR |
| 805 | UCAGCUAAAGUCAUUUGUAGUUU | AAACUACAAAUGACUUUAGCUGA | | [842-864] 3'UTR |
| 806 | GUCAGCUAAAGUCAUUUGUAGUU | AACUACAAAUGACUUUAGCUGAC | | [841-863] 3'UTR |
| 807 | AGUCAGCUAAAGUCAUUUGUAGU | ACUACAAAUGACUUUAGCUGACU | | [840-862] 3'UTR |
| 808 | UAGUCAGCUAAAGUCAUUUGUAG | CUACAAAUGACUUUAGCUGACUA | | [839-861] 3'UTR |
| 809 | GGCUUUUUUUCUCUAAGUUUUC | GAAAACUUAGAGAAAAAAAGCC | | [1153-1175] 3'UTR |
| 810 | UGGCUUUUUUUCUCUAAGUUUU | AAAACUUAGAGAAAAAAAGCCA | | [1152-1174] 3'UTR |
| 811 | AUGGCUUUUUUUCUCUAAGUUU | AAACUUAGAGAAAAAAAGCCAU | | [1151-1173] 3'UTR |
| 812 | UAUGGCUUUUUUUCUCUAAGUU | AACUUAGAGAAAAAAAGCCAUA | | [1150-1172] 3'UTR |
| 813 | AUAUGGCUUUUUUUCUCUAAGU | ACUUAGAGAAAAAAAGCCAUAU | | [1149-1171] 3'UTR |
| 814 | UAUGCACGUGAACUUGGAAAUUG | CAAUUUCCAAGUUCACGUGCAUA | Dog, Chin, GP, Rat | [524-546] ORF |
| 815 | UUAUGCACGUGAACUUGGAAAUU | AAUUUCCAAGUUCACGUGCAUAA | Dog, Chin, GP, Rat | [523-545] ORF |
| 816 | GUUAUGCACGUGAACUUGGAAAU | AUUUCCAAGUUCACGUGCAUAAC | Dog, Chin, GP, Rat | [522-544] ORF |
| 817 | UGUUAUGCACGUGAACUUGGAAA | UUUCCAAGUUCACGUGCAUAACA | Dog, Chin, GP, Rat | [521-543] ORF |
| 818 | GUGUUAUGCACGUGAACUUGGAA | UUCCAAGUUCACGUGCAUAACAC | Dog, Chin, GP, Rat | [520-542] ORF |
| 819 | AUGGACUAGCUUCAGGGACUUUU | AAAAGUCCCUGAAGCUAGUCCAU | Chimp | [641-663] ORF |
| 820 | CGUUGACCAUGGUUGCAACUGGC | GCCAGUUGCAACCAUGGUCAACG | Chimp, Rat, Ms | [196-218] 5'UTR + ORF |
| 821 | CCGUUGACCAUGGUUGCAACUGG | CCAGUUGCAACCAUGGUCAACGG | Chimp, Rat, Ms | [195-217] 5'UTR + ORF |
| 822 | GCCGUUGACCAUGGUUGCAACUG | CAGUUGCAACCAUGGUCAACGGC | Chimp, Rat, Ms | [194-216] 5'UTR + ORF |
| 823 | AGCCGUUGACCAUGGUUGCAACU | AGUUGCAACCAUGGUCAACGGCU | Chimp, Rat, Ms | [193-215] 5'UTR + ORF |
| 824 | GAGCCGUUGACCAUGGUUGCAAC | GUUGCAACCAUGGUCAACGGCUC | Chimp, Rat, Ms | [192-214] 5'UTR + ORF |
| 825 | UGCAUGUCUAUUGUUAAGCUCCA | UGGAGCUUAACAAUAGACAUGCA | | [2337-2359] 3'UTR |
| 826 | CAAUUUACGAAGUCUGCAUUGGC | GCCAAUGCAGACUUCGUAAAUUG | | [1815-1837] 3'UTR |

TABLE E-continued additional 23 mers

| Number | Sense siRNA | AntiSense siRNA | Other Sp | Hum-34222182 ORF: 204-785 |
|---|---|---|---|---|
| 827 | UCAAUUUACGAAGUCUGCAUUGG | CCAAUGCAGACUUCGUAAAUUGA | | [1814-1836] 3'UTR |
| 828 | GUCAAUUUACGAAGUCUGCAUUG | CAAUGCAGACUUCGUAAAUUGAC | | [1813-1835] 3'UTR |
| 829 | GGUCAAUUUACGAAGUCUGCAUU | AAUGCAGACUUCGUAAAUUGACC | | [1812-1834] 3'UTR |
| 830 | GGGUCAAUUUACGAAGUCUGCAU | AUGCAGACUUCGUAAAUUGACCC | | [1811-1833] 3'UTR |
| 831 | CUAGUCAGCUAAAGUCAUUUGUA | UACAAAUGACUUUAGCUGACUAG | | [838-860] 3'UTR |
| 832 | AAAGCUGGAUAGGAUUGUGUGUG | CACACACAAUCCUAUCCAGCUUU | Chin, GP, Chimp, Rat | [560-582] ORF |
| 833 | AAAAGCUGGAUAGGAUUGUGUGU | ACACACAAUCCUAUCCAGCUUUU | Chin, GP, Chimp, Rat | [559-581] ORF |
| 834 | GUACAGCCUAGAGAAUGAAACUC | GAGUUUCAUUCUCUAGGCUGUAC | | [1857-1879] 3'UTR |
| 835 | GAUUCUAGCGUCGUACCACUUU | AAAGUAGGUACGACGCUAGAAUC | | [582-604] ORF |
| 836 | UGAUUCUAGCGUCGUACCACUU | AAGUAGGUACGACGCUAGAAUCA | | [581-603] ORF |
| 837 | GUGAUUCUAGCGUCGUACCACU | AGUAGGUACGACGCUAGAAUCAC | | [580-602] ORF |
| 838 | UGUGAUUCUAGCGUCGUACCAC | GUAGGUACGACGCUAGAAUCACA | | [579-601] ORF |
| 839 | GAUCUAGUCCCUCUCUGAUUCAC | GUGAAUCAGAGAGGGACUAGAUC | | [1620-1642] 3'UTR |
| 840 | CUAACAAACUAAACUCUUCAAAU | AUUUGAAGAGUUUAGUUUGUUAG | | [2251-2273] 3'UTR |
| 841 | UCUAACAAACUAAACUCUUCAAA | UUUGAAGAGUUUAGUUUGUUAGA | | [2250-2272] 3'UTR |
| 842 | UUCUAACAAACUAAACUCUUCAA | UUGAAGAGUUUAGUUUGUUAGAA | | [2249-2271] 3'UTR |
| 843 | GACUCAAAUUUGAAGGGUUUUUA | UAAAAACCCUUCAAAUUUGAGUC | | [1257-1279] 3'UTR |
| 844 | UGACUCAAAUUUGAAGGGUUUUU | AAAAACCCUUCAAAUUUGAGUCA | | [1256-1278] 3'UTR |
| 845 | CUGACUCAAAUUUGAAGGGUUUU | AAAACCCUUCAAAUUUGAGUCAG | | [1255-1277] 3'UTR |
| 846 | CCUGACUCAAAUUUGAAGGGUUU | AAACCCUUCAAAUUUGAGUCAGG | | [1254-1276] 3'UTR |
| 847 | UCCUGACUCAAAUUUGAAGGGUU | AACCCUUCAAAUUUGAGUCAGGA | | [1253-1275] 3'UTR |
| 848 | UCCACUCAACAAUGUUCAAUUCA | UGAAUUGAACAUUGUUGAGUGGA | | [2027-2049] 3'UTR |
| 849 | CUCCACUCAACAAUGUUCAAUUC | GAAUUGAACAUUGUUGAGUGGAG | | [2026-2048] 3'UTR |
| 850 | CCUCCACUCAACAAUGUUCAAUU | AAUUGAACAUUGUUGAGUGGAGG | | [2025-2047] 3'UTR |
| 851 | GCCUCCACUCAACAAUGUUCAAU | AUUGAACAUUGUUGAGUGGAGGC | | [2024-2046] 3'UTR |
| 852 | AGCCUCCACUCAACAAUGUUCAA | UUGAACAUUGUUGAGUGGAGGCU | | [2023-2045] 3'UTR |
| 853 | UGUAGAUUUUCUGCAUAGAUCCC | GGGAUCUAUGCAGAAAAUCUACA | | [986-1008] 3'UTR |
| 854 | GUGUAGAUUUUCUGCAUAGAUCC | GGAUCUAUGCAGAAAAUCUACAC | | [985-1007] 3'UTR |
| 855 | GCUAUGGAGAUAUGGUUUAUAGU | ACUAUAAACCAUAUCUCCAUAGC | | [1836-1858] 3'UTR |
| 856 | GGCUAUGGAGAUAUGGUUUAUAG | CUAUAAACCAUAUCUCCAUAGCC | | [1835-1857] 3'UTR |
| 857 | UGGCUAUGGAGAUAUGGUUUAUA | UAUAAACCAUAUCUCCAUAGCCA | | [1834-1856] 3'UTR |
| 858 | UUGGCUAUGGAGAUAUGGUUUAU | AUAAACCAUAUCUCCAUAGCCAA | | [1833-1855] 3'UTR |
| 859 | AUUGGCUAUGGAGAUAUGGUUUA | UAAACCAUAUCUCCAUAGCCAAU | | [1832-1854] 3'UTR |
| 860 | GUAUACUACCACUUUGAAUUAUU | AAUAAUUCAAAGUGGUAGUAUAC | | [1783-1805] 3'UTR |
| 861 | UGUAUACUACCACUUUGAAUUAU | AUAAUUCAAAGUGGUAGUAUACA | | [1782-1804] 3'UTR |
| 862 | CUGUAUACUACCACUUUGAAUUA | UAAUUCAAAGUGGUAGUAUACAG | | [1781-1803] 3'UTR |
| 863 | GCUGUAUACUACCACUUUGAAUU | AAUUCAAAGUGGUAGUAUACAGC | | [1780-1802] 3'UTR |

TABLE E-continued additional 23 mers

| Number | Sense siRNA | AntiSense siRNA | Other Sp | Hum-34222182 ORF: 204-785 |
|---|---|---|---|---|
| 864 | AGCUGUAUACUACCACUUUGAAU | AUUCAAAGUGGUAGUAUACAGCU | | [1779-1801] 3'UTR |
| 865 | AGAGCCGUUGACCAUGGUUGCAA | UUGCAACCAUGGUCAACGGCUCU | Chimp, Rat, Ms | [191-213] 5'UTR + ORF |
| 866 | GAAUUAUUGAAACGGGUCAAUUU | AAAUUGACCCGUUUCAAUAAUUC | | [1798-1820] 3'UTR |
| 867 | UGAAUUAUUGAAACGGGUCAAUU | AAUUGACCCGUUUCAAUAAUUCA | | [1797-1819] 3'UTR |
| 868 | UUGAAUUAUUGAAACGGGUCAAU | AUUGACCCGUUUCAAUAAUUCAA | | [1796-1818] 3'UTR |
| 869 | UUUGAAUUAUUGAAACGGGUCAA | UUGACCCGUUUCAAUAAUUCAAA | | [1795-1817] 3'UTR |
| 870 | CUUUGAAUUAUUGAAACGGGUCA | UGACCCGUUUCAAUAAUUCAAAG | | [1794-1816] 3'UTR |
| 871 | AGCCCAUUUGAGUUUUACAUUUG | CAAAUGUAAAACUCAAAUGGGCU | | [1056-1078] 3'UTR |
| 872 | AAGCCCAUUUGAGUUUUACAUUU | AAAUGUAAAACUCAAAUGGGCUU | | [1055-1077] 3'UTR |
| 873 | AGGAUUGUGUGUGAUUCUAGCGU | ACGCUAGAAUCACACACAAUCCU | Chimp | [570-592] ORF |
| 874 | UAGGAUUGUGUGUGAUUCUAGCG | CGCUAGAAUCACACACAAUCCUA | Chimp | [569-591] ORF |
| 875 | AUAGGAUUGUGUGUGAUUCUAGC | GCUAGAAUCACACACAAUCCUAU | Chimp | [568-590] ORF |
| 876 | GAUAGGAUUGUGUGUGAUUCUAG | CUAGAAUCACACACAAUCCUAUC | Chimp | [567-589] ORF |
| 877 | CAAAUGCUUGGAAAGAUACUACA | UGUAGUAUCUUUCCAAGCAUUUG | | [2269-2291] 3'UTR |
| 878 | CAUUGGCUAUGGAGAUAUGGUUU | AAACCAUAUCUCCAUAGCCAAUG | | [1831-1853] 3'UTR |
| 879 | CUUUUUCCACUAACAGUUAUCUU | AAGAUAACUGUUAGUGGAAAAAG | | [2446-2468] 3'UTR |
| 880 | CCUUUUUCCACUAACAGUUAUCU | AGAUAACUGUUAGUGGAAAAAGG | | [2445-2467] 3'UTR |
| 881 | UCCUUUUUCCACUAACAGUUAUC | GAUAACUGUUAGUGGAAAAAGGA | | [2444-2466] 3'UTR |
| 882 | GUCCUUUUUCCACUAACAGUUAU | AUAACUGUUAGUGGAAAAAGGAC | | [2443-2465] 3'UTR |
| 883 | UGUCCUUUUUCCACUAACAGUUA | UAACUGUUAGUGGAAAAAGGACA | | [2442-2464] 3'UTR |
| 884 | UGCACCCAGAUUUUUUCCACCUU | AAGGUGGAAAAAAUCUGGGUGCA | | [1900-1922] 3'UTR |
| 885 | GGUCCUAAAAAGGGAAAAUAUAU | AUAUAUUUUCCCUUUUUAGGACC | | [778-800] ORF + 3'UTR |
| 886 | GCUUCAGGGACUUUUUCUUUAGU | ACUAAAGAAAAAGUCCCUGAAGC | Chimp | [649-671] ORF |
| 887 | AGCUUCAGGGACUUUUUCUUUAG | CUAAAGAAAAAGUCCCUGAAGCU | Chimp | [648-670] ORF |
| 888 | UAGCUUCAGGGACUUUUUCUUUA | UAAAGAAAAAGUCCCUGAAGCUA | Chimp | [647-669] ORF |
| 889 | CUAAUGUUUAAAGAGGCAACAA | UUGUUGCCUCUUUAAACAUUAG | | [1399-1421] 3'UTR |
| 890 | GGAAUAAUAAAGGCCUUAUUUUU | AAAAAUAAGGCCUUUAUUAUUCC | | [1939-1961] 3'UTR |
| 891 | UUGCAUGUCUAUUGUUAAGCUCC | GGAGCUUAACAAUAGACAUGCAA | | [2336-2358] 3'UTR |
| 892 | UUUGCAUGUCUAUUGUUAAGCUC | GAGCUUAACAAUAGACAUGCAAA | | [2335-2357] 3'UTR |
| 893 | UUUUGCAUGUCUAUUGUUAAGCU | AGCUUAACAAUAGACAUGCAAAA | | [2334-2356] 3'UTR |
| 894 | UAGCUGUAUACUACCACUUUGAA | UUCAAAGUGGUAGUAUACAGCUA | | [1778-1800] 3'UTR |
| 895 | GUAGCUGUAUACUACCACUUUGA | UCAAAGUGGUAGUAUACAGCUAC | | [1777-1799] 3'UTR |
| 896 | GUAGAUUUUCUGCAUAGAUCCCA | UGGGAUCUAUGCAGAAAAUCUAC | | [987-1009] 3'UTR |
| 897 | UGUGUUAUGCACGUGAACUUGGA | UCCAAGUUCACGUGCAUAACACA | Dog, Chin, GP, Rat, Ms | [519-541] ORF |
| 898 | GAAACUGACCCAGAGAAUUGCUC | GAGCAAUUCUCUGGGUCAGUUUC | Chin, GP, Chimp, Rat, Ms | [449-471] ORF |
| 899 | GAAACUCACCGUCCAGAUAACCA | UGGUUAUCUGGACGGUGAGUUUC | | [1873-1895] 3'UTR |
| 900 | UGAAACUCACCGUCCAGAUAACC | GGUUAUCUGGACGGUGAGUUUCA | | [1872-1894] 3'UTR |

TABLE E-continued additional 23 mers

| Number | Sense siRNA | AntiSense siRNA | Other Sp | Hum-34222182 ORF: 204-785 |
|---|---|---|---|---|
| 901 | AUGAAACUCACCGUCCAGAUAAC | GUUAUCUGGACGGUGAGUUUCAU | | [1871-1893] 3'UTR |
| 902 | AAUGAAACUCACCGUCCAGAUAA | UUAUCUGGACGGUGAGUUUCAUU | | [1870-1892] 3'UTR |
| 903 | GAAACAGAGCCGUUGACCAUGGU | ACCAUGGUCAACGGCUCUGUUUC | Dog, Chimp, Rat, Ms | [186-208] 5'UTR + ORF |
| 904 | GGAAACAGAGCCGUUGACCAUGG | CCAUGGUCAACGGCUCUGUUUCC | Dog, Chimp, Rat, Ms | [185-207] 5'UTR + ORF |
| 905 | AGGAAACAGAGCCGUUGACCAUG | CAUGGUCAACGGCUCUGUUUCCU | Dog, Chimp, Rat, Ms | [184-206] 5'UTR + ORF |
| 906 | AAGGAAACAGAGCCGUUGACCAU | AUGGUCAACGGCUCUGUUUCCUU | Dog, Chimp, Rat, Ms | [183-205] 5'UTR + ORF |
| 907 | GAAGGAAACAGAGCCGUUGACCA | UGGUCAACGGCUCUGUUUCCUUC | Dog, Chimp, Rat, Ms | [182-204] 5'UTR |
| 908 | UACAGCCUAGAGAAUGAAACUCA | UGAGUUUCAUUCUCUAGGCUGUA | | [1858-1880] 3'UTR |
| 909 | GGAGAACUCUGAUCCUCAGCUCA | UGAGCUGAGGAUCAGAGUUCUCC | | [697-719] ORF |
| 910 | AGGAGAACUCUGAUCCUCAGCUC | GAGCUGAGGAUCAGAGUUCUCCU | | [696-718] ORF |
| 911 | CAGGAGAACUCUGAUCCUCAGCU | AGCUGAGGAUCAGAGUUCUCCUG | | [695-717] ORF |
| 912 | UCAGGAGAACUCUGAUCCUCAGC | GCUGAGGAUCAGAGUUCUCCUGA | | [694-716] ORF |
| 913 | UUCAGGAGAACUCUGAUCCUCAG | CUGAGGAUCAGAGUUCUCCUGAA | | [693-715] ORF |
| 914 | UUCAGGGACUUUUUCUUUAGUAG | CUACUAAAGAAAAGUCCCUGAA | | [651-673] ORF |
| 915 | CUUCAGGGACUUUUUCUUUAGUA | UACUAAAGAAAAGUCCCUGAAG | | [650-672] ORF |
| 916 | AGUUGAUUACUCUUCCAUUGAGU | ACUCAAUGGAAGAGUAAUCAACU | | [1558-1580] 3'UTR |
| 917 | UAGUUGAUUACUCUUCCAUUGAG | CUCAAUGGAAGAGUAAUCAACUA | | [1557-1579] 3'UTR |
| 918 | GUAGUUGAUUACUCUUCCAUUGA | UCAAUGGAAGAGUAAUCAACUAC | | [1556-1578] 3'UTR |
| 919 | UGUAGUUGAUUACUCUUCCAUUG | CAAUGGAAGAGUAAUCAACUACA | | [1555-1577] 3'UTR |
| 920 | GUGUAGUUGAUUACUCUUCCAUU | AAUGGAAGAGUAAUCAACUACAC | | [1554-1576] 3'UTR |
| 921 | GGAACAACAGUGAUUGAAGGGUC | GACCCUUCAAUCACUGUUGUUCC | | [759-781] ORF |
| 922 | UGGAACAACAGUGAUUGAAGGGU | ACCCUUCAAUCACUGUUGUUCCA | | [758-780] ORF |
| 923 | UUGGAACAACAGUGAUUGAAGGG | CCCUUCAAUCACUGUUGUUCCAA | | [757-779] ORF |
| 924 | AUUGGAACAACAGUGAUUGAAGG | CCUUCAAUCACUGUUGUUCCAAU | | [756-778] ORF |
| 925 | GAUUGGAACAACAGUGAUUGAAG | CUUCAAUCACUGUUGUUCCAAUC | | [755-777] ORF |
| 926 | CAAAGCCAAUCUUUAUAGAAUUG | CAAUUCUAUAAAGAUUGGCUUUG | | [2290-2312] 3'UTR |
| 927 | ACAAAGCCAAUCUUUAUAGAAUU | AAUUCUAUAAAGAUUGGCUUUGU | | [2289-2311] 3'UTR |
| 928 | UACAAAGCCAAUCUUUAUAGAAU | AUUCUAUAAAGAUUGGCUUUGUA | | [2288-2310] 3'UTR |
| 929 | CUACAAAGCCAAUCUUUAUAGAA | UUCUAUAAAGAUUGGCUUUGUAG | | [2287-2309] 3'UTR |
| 930 | ACUACAAAGCCAAUCUUUAUAGA | UCUAUAAAGAUUGGCUUUGUAGU | | [2286-2308] 3'UTR |
| 931 | AAACGGGUCAAUUUACGAAGUCU | AGACUUCGUAAAUUGACCCGUUU | | [1807-1829] 3'UTR |
| 932 | GCAAGGCUUCUUGGGCAUCGAUG | CAUCGAUGCCCAAGAAGCCUUGC | | [2410-2432] 3'UTR |
| 933 | GGCAAGGCUUCUUGGGCAUCGAU | AUCGAUGCCCAAGAAGCCUUGCC | | [2409-2431] 3'UTR |
| 934 | GGGCAAGGCUUCUUGGGCAUCGA | UCGAUGCCCAAGAAGCCUUGCCC | | [2408-2430] 3'UTR |
| 935 | UCCCUGAGAAACUGACCCAGAGA | UCUCUGGGUCAGUUUCUCAGGGA | Dog, Chin, GP, Chimp, Rat, Ms | [442-464] ORF |
| 936 | GUCCCUGAGAAACUGACCCAGAG | CUCUGGGUCAGUUUCUCAGGGAC | Dog, Chin, GP, Chimp, Rat, Ms | [441-463] ORF |

TABLE E-continued additional 23 mers

| Number | Sense siRNA | AntiSense siRNA | Other Sp | Hum-34222182 ORF: 204-785 |
|---|---|---|---|---|
| 937 | UGUCCCUGAGAAACUGACCCAGA | UCUGGGUCAGUUUCUCAGGGACA | Dog, Chin, GP, Chimp, Rat, Ms | [440-462] ORF |
| 938 | CUGCAUUGGCUAUGGAGAUAUGG | CCAUAUCUCCAUAGCCAAUGCAG | | [1828-1850] 3'UTR |
| 939 | UCUGCAUUGGCUAUGGAGAUAUG | CAUAUCUCCAUAGCCAAUGCAGA | | [1827-1849] 3'UTR |
| 940 | GUCUGCAUUGGCUAUGGAGAUAU | AUAUCUCCAUAGCCAAUGCAGAC | | [1826-1848] 3'UTR |
| 941 | AGUCUGCAUUGGCUAUGGAGAUA | UAUCUCCAUAGCCAAUGCAGACU | | [1825-1847] 3'UTR |
| 942 | AAGUCUGCAUUGGCUAUGGAGAU | AUCUCCAUAGCCAAUGCAGACUU | | [1824-1846] 3'UTR |
| 943 | GAUUGUGUGUGAUUCUAGCGUCG | CGACGCUAGAAUCACACACAAUC | | [572-594] ORF |
| 944 | GGAUUGUGUGUGAUUCUAGCGUC | GACGCUAGAAUCACACACAAUCC | | [571-593] ORF |
| 945 | GCUAGUCAGCUAAAGUCAUUUGU | ACAAAUGACUUUAGCUGACUAGC | | [837-859] 3'UTR |
| 946 | AGCUAGUCAGCUAAAGUCAUUUG | CAAAUGACUUUAGCUGACUAGCU | | [836-858] 3'UTR |
| 947 | CAGCUAGUCAGCUAAAGUCAUUU | AAAUGACUUUAGCUGACUAGCUG | | [835-857] 3'UTR |
| 948 | UCAGCUAGUCAGCUAAAGUCAUU | AAUGACUUUAGCUGACUAGCUGA | | [834-856] 3'UTR |
| 949 | UUCAGCUAGUCAGCUAAAGUCAU | AUGACUUUAGCUGACUAGCUGAA | | [833-855] 3'UTR |
| 950 | UGUAUUCAUCCUGGUGUUACUGA | UCAGUAACACCAGGAUGAAUACA | | [2158-2180] 3'UTR |
| 951 | AUGUAUUCAUCCUGGUGUUACUG | CAGUAACACCAGGAUGAAUACAU | | [2157-2179] 3'UTR |
| 952 | GAUGUAUUCAUCCUGGUGUUACU | AGUAACACCAGGAUGAAUACAUC | | [2156-2178] 3'UTR |
| 953 | GGGUAGUAAAACUAUUCAGCUAG | CUAGCUGAAUAGUUUUACUACCC | | [819-841] 3'UTR |
| 954 | UGGGUAGUAAAACUAUUCAGCUA | UAGCUGAAUAGUUUUACUACCCA | | [818-840] 3'UTR |
| 955 | UUGGGUAGUAAAACUAUUCAGCU | AGCUGAAUAGUUUUACUACCCAA | | [817-839] 3'UTR |
| 956 | AUUGGGUAGUAAAACUAUUCAGC | GCUGAAUAGUUUUACUACCCAAU | | [816-838] 3'UTR |
| 957 | UGAUUGGAACAACAGUGAUUGAA | UUCAAUCACUGUUGUUCCAAUCA | | [754-776] ORF |
| 958 | CUGAUUGGAACAACAGUGAUUGA | UCAAUCACUGUUGUUCCAAUCAG | | [753-775] ORF |
| 959 | ACUGAUUGGAACAACAGUGAUUG | CAAUCACUGUUGUUCCAAUCAGU | | [752-774] ORF |
| 960 | CACUGAUUGGAACAACAGUGAUU | AAUCACUGUUGUUCCAAUCAGUG | | [751-773] ORF |
| 961 | CAGUUAUCUUUGACUCUCUUGCC | GGCAAGAGAGUCAAAGAUAACUG | | [2459-2481] 3'UTR |
| 962 | ACAGUUAUCUUUGACUCUCUUGC | GCAAGAGAGUCAAAGAUAACUGU | | [2458-2480] 3'UTR |
| 963 | AACAGUUAUCUUUGACUCUCUUG | CAAGAGAGUCAAAGAUAACUGUU | | [2457-2479] 3'UTR |
| 964 | UAACAGUUAUCUUUGACUCUCUU | AAGAGAGUCAAAGAUAACUGUUA | | [2456-2478] 3'UTR |
| 965 | CUAACAGUUAUCUUUGACUCUCU | AGAGAGUCAAAGAUAACUGUUAG | | [2455-2477] 3'UTR |
| 966 | CACAAUUUGGUUUCAGGUAGGCU | AGCCUACCUGAAACCAAAUUGUG | | [1083-1105] 3'UTR |
| 967 | CCACAAUUUGGUUUCAGGUAGGC | GCCUACCUGAAACCAAAUUGUGG | | [1082-1104] 3'UTR |
| 968 | UCCACAAUUUGGUUUCAGGUAGG | CCUACCUGAAACCAAAUUGUGGA | | [1081-1103] 3'UTR |
| 969 | UUCCACAAUUUGGUUUCAGGUAG | CUACCUGAAACCAAAUUGUGGAA | | [1080-1102] 3'UTR |
| 970 | AUUCCACAAUUUGGUUUCAGGUA | UACCUGAAACCAAAUUGUGGAAU | | [1079-1101] 3'UTR |
| 971 | GAGAAGUGAUUCAAAAUAGUGUA | UACACUAUUUUGAAUCACUUCUC | | [967-989] 3'UTR |
| 972 | GCUUUUCUGGGAAUUGAAGUAUC | GAUACUUCAAUUCCCAGAAAAGC | | [1727-1749] 3'UTR |
| 973 | GAAGUCUGCAUUGGCUAUGGAGA | UCUCCAUAGCCAAUGCAGACUUC | | [1823-1845] 3'UTR |

TABLE E-continued additional 23 mers

| Number | Sense siRNA | AntiSense siRNA | Other Sp | Hum-34222182 ORF: 204-785 |
|---|---|---|---|---|
| 974 | UACUACAAAGCCAAUCUUUAUAG | CUAUAAAGAUUGGCUUUGUAGUA | | [2285-2307] 3'UTR |
| 975 | AUACUACAAAGCCAAUCUUUAUA | UAUAAAGAUUGGCUUUGUAGUAU | | [2284-2306] 3'UTR |
| 976 | GAUACUACAAAGCCAAUCUUUAU | AUAAAGAUUGGCUUUGUAGUAUC | | [2283-2305] 3'UTR |
| 977 | AGAUACUACAAAGCCAAUCUUUA | UAAAGAUUGGCUUUGUAGUAUCU | | [2282-2304] 3'UTR |
| 978 | AAAAUAGUGUAGAUUUUCUGCAU | AUGCAGAAAAUCUACACUAUUUU | | [979-1001] 3'UTR |
| 979 | AAGCAAAAGUAGAAGCCCAUUUG | CAAAUGGGCUUCUACUUUUGCUU | | [1043-1065] 3'UTR |
| 980 | UAAGCAAAAGUAGAAGCCCAUUU | AAAUGGGCUUCUACUUUUGCUUA | | [1042-1064] 3'UTR |
| 981 | GUAAGCAAAAGUAGAAGCCCAUU | AAUGGGCUUCUACUUUUGCUUAC | | [1041-1063] 3'UTR |
| 982 | CGGGUCAAUUUACGAAGUCUGCA | UGCAGACUUCGUAAAUUGACCCG | | [1810-1832] 3'UTR |
| 983 | ACGGGUCAAUUUACGAAGUCUGC | GCAGACUUCGUAAAUUGACCCGU | | [1809-1831] 3'UTR |
| 984 | AACGGGUCAAUUUACGAAGUCUG | CAGACUUCGUAAAUUGACCCGUU | | [1808-1830] 3'UTR |
| 985 | UCACUGAUUGGAACAACAGUGAU | AUCACUGUUGUUCCAAUCAGUGA | | [750-772] ORF |
| 986 | AAUUCAGCAAGGCUUUCAUAUCC | GGAUAUGAAAGCCUUGCUGAAUU | | [2044-2066] 3'UTR |
| 987 | CAAUUCAGCAAGGCUUUCAUAUC | GAUAUGAAAGCCUUGCUGAAUUG | | [2043-2065] 3'UTR |
| 988 | UCAAUUCAGCAAGGCUUUCAUAU | AUAUGAAAGCCUUGCUGAAUUGA | | [2042-2064] 3'UTR |
| 989 | UUCAAUUCAGCAAGGCUUUCAUA | UAUGAAAGCCUUGCUGAAUUGAA | | [2041-2063] 3'UTR |
| 990 | GUUCAAUUCAGCAAGGCUUUCAU | AUGAAAGCCUUGCUGAAUUGAAC | | [2040-2062] 3'UTR |
| 991 | AUGAAUACCUGUGAGGAUAGGAA | UUCCUAUCCUCACAGGUAUUCAU | | [1586-1608] 3'UTR |
| 992 | UUAUUUCAUGAUUGGGUAGUAAA | UUUACUACCCAAUCAUGAAAUAA | | [806-828] 3'UTR |
| 993 | AGAGAGCCUGCUAAGUGAUUUUG | CAAAAUCACUUAGCAGGCUCUCU | Chimp | [278-300] ORF |
| 994 | UUAACCCUAGGUAAGAGUAAAUG | CAUUUACUCUUACCUAGGGUUAA | | [1320-1342] 3'UTR |
| 995 | CUUAACCCUAGGUAAGAGUAAAU | AUUUACUCUUACCUAGGGUUAAG | | [1319-1341] 3'UTR |
| 996 | GCUUAACCCUAGGUAAGAGUAAA | UUUACUCUUACCUAGGGUUAAGC | | [1318-1340] 3'UTR |
| 997 | AGCUUAACCCUAGGUAAGAGUAA | UUACUCUUACCUAGGGUUAAGCU | | [1317-1339] 3'UTR |
| 998 | AGAACUGUUGUCCUUUUUCCACU | AGUGGAAAAGGACAACAGUUCU | | [2434-2456] 3'UTR |
| 999 | UAGAACUGUUGUCCUUUUUCCAC | GUGGAAAAGGACAACAGUUCUA | | [2433-2455] 3'UTR |
| 1000 | GUAGAACUGUUGUCCUUUUUCCA | UGGAAAAGGACAACAGUUCUAC | | [2432-2454] 3'UTR |
| 1001 | GCAUUUCAGAAUUGCUGGACUGU | ACAGUCCAGCAAUUCUGAAAUGC | Chimp | [244-266] ORF |
| 1002 | AGCAUUUCAGAAUUGCUGGACUG | CAGUCCAGCAAUUCUGAAAUGCU | Chimp | [243-265] ORF |
| 1003 | CAGCAUUUCAGAAUUGCUGGACU | AGUCCAGCAAUUCUGAAAUGCUG | Chimp | [242-264] ORF |
| 1004 | CCAGCAUUUCAGAAUUGCUGGAC | GUCCAGCAAUUCUGAAAUGCUGG | Chimp | [241-263] ORF |
| 1005 | GCCAGCAUUUCAGAAUUGCUGGA | UCCAGCAAUUCUGAAAUGCUGGC | Chimp | [240-262] ORF |
| 1006 | GUACCUACUUUUGAGCUUACACU | AGUGUAAGCUCAAAAGUAGGUAC | | [594-616] ORF |
| 1007 | CGUACCUACUUUUGAGCUUACAC | GUGUAAGCUCAAAAGUAGGUACG | | [593-615] ORF |
| 1008 | UCGUACCUACUUUUGAGCUUACA | UGUAAGCUCAAAAGUAGGUACGA | | [592-614] ORF |
| 1009 | GUCGUACCUACUUUUGAGCUUAC | GUAAGCUCAAAAGUAGGUACGAC | | [591-613] ORF |
| 1010 | GUCUUAUUCCAACUAAGUAGAUC | GAUCUACUUAGUUGGAAUAAGAC | | [1963-1985] 3'UTR |

TABLE E-continued additional 23 mers

| Number | Sense siRNA | AntiSense siRNA | Other Sp | Hum-34222182 ORF: 204-785 |
|---|---|---|---|---|
| 1011 | UGUCUUAUUCCAACUAAGUAGAU | AUCUACUUAGUUGGAAUAAGACA | | [1962-1984] 3'UTR |
| 1012 | UUGUCUUAUUCCAACUAAGUAGA | UCUACUUAGUUGGAAUAAGACAA | | [1961-1983] 3'UTR |
| 1013 | UUUGUCUUAUUCCAACUAAGUAG | CUACUUAGUUGGAAUAAGACAAA | | [1960-1982] 3'UTR |
| 1014 | UUUUGUCUUAUUCCAACUAAGUA | UACUUAGUUGGAAUAAGACAAAA | | [1959-1981] 3'UTR |
| 1015 | UUGUGUUUAAGCAGGAGAACUGC | GCAGUUCUCCUGCUUAAACACAA | Dog, Chimp | [616-638] ORF |
| 1016 | CUUGUGUUUAAGCAGGAGAACUG | CAGUUCUCCUGCUUAAACACAAG | Dog, Chimp | [615-637] ORF |
| 1017 | ACUUGUGUUUAAGCAGGAGAACU | AGUUCUCCUGCUUAAACACAAGU | Dog, Chimp | [614-636] ORF |
| 1018 | CACUUGUGUUUAAGCAGGAGAAC | GUUCUCCUGCUUAAACACAAGUG | Dog, Chimp | [613-635] ORF |
| 1019 | ACACUUGUGUUUAAGCAGGAGAA | UUCUCCUGCUUAAACACAAGUGU | Dog, Chimp | [612-634] ORF |
| 1020 | AACUUGCCAGAAUUUGGUUAAAA | UUUUAACCAAAUUCUGGCAAGUU | GP, Chimp, Rat, Ms | [359-381] ORF |
| 1021 | UCUAAUGUUUAAAGAGGCAACA | UGUUGCCUCUUUAAACAUUAGA | | [1398-1420] 3'UTR |
| 1022 | CUCUAAUGUUUAAAGAGGCAAC | GUUGCCUCUUUAAACAUUAGAG | | [1397-1419] 3'UTR |
| 1023 | ACUCUAAUGUUUAAAGAGGCAA | UUGCCUCUUUAAACAUUAGAGU | | [1396-1418] 3'UTR |
| 1024 | CACUCUAAUGUUUAAAGAGGCA | UGCCUCUUUAAACAUUAGAGUG | | [1395-1417] 3'UTR |
| 1025 | CUAAGUUUUCAGAGGAUUUUUA | UAAAAAUCCUCUGAAAACUUAG | | [1166-1188] 3'UTR |
| 1026 | UCUAAGUUUUCAGAGGAUUUUU | AAAAAUCCUCUGAAAACUUAGA | | [1165-1187] 3'UTR |
| 1027 | CUCUAAGUUUUCAGAGGAUUUU | AAAAUCCUCUGAAAACUUAGAG | | [1164-1186] 3'UTR |
| 1028 | UCUCUAAGUUUUCAGAGGAUUU | AAAUCCUCUGAAAACUUAGAGA | | [1163-1185] 3'UTR |
| 1029 | UUCUCUAAGUUUUCAGAGGAUU | AAUCCUCUGAAAACUUAGAGAA | | [1162-1184] 3'UTR |
| 1030 | UGGUUUAUAGUACAGCCUAGAGA | UCUCUAGGCUGUACUAUAAACCA | | [1848-1870] 3'UTR |
| 1031 | AUGGUUUAUAGUACAGCCUAGAG | CUCUAGGCUGUACUAUAAACCAU | | [1847-1869] 3'UTR |
| 1032 | UAUGGUUUAUAGUACAGCCUAGA | UCUAGGCUGUACUAUAAACCAUA | | [1846-1868] 3'UTR |
| 1033 | AUAUGGUUUAUAGUACAGCCUAG | CUAGGCUGUACUAUAAACCAUAU | | [1845-1867] 3'UTR |
| 1034 | UCCUCUGGUUUCAGGAGAACUCU | AGAGUUCUCCUGAAACCAGAGGA | | [684-706] ORF |
| 1035 | CUCCUCUGGUUUCAGGAGAACUC | GAGUUCUCCUGAAACCAGAGGAG | | [683-705] ORF |
| 1036 | UCUCCUCUGGUUUCAGGAGAACU | AGUUCUCCUGAAACCAGAGGAGA | | [682-704] ORF |
| 1037 | UUCUCCUCUGGUUUCAGGAGAAC | GUUCUCCUGAAACCAGAGGAGAA | | [681-703] ORF |
| 1038 | CUUCUCCUCUGGUUUCAGGAGAA | UUCUCCUGAAACCAGAGGAGAAG | | [680-702] ORF |
| 1039 | UGUUGUUUUAGAUGCCUUUAUAA | UUAUAAAGGCAUCUAAAACAACA | | [1452-1474] 3'UTR |
| 1040 | GUGUUGUUUUAGAUGCCUUUAUA | UAUAAAGGCAUCUAAAACAACAC | | [1451-1473] 3'UTR |
| 1041 | GGUGUUGUUUUAGAUGCCUUUAU | AUAAAGGCAUCUAAAACAACACC | | [1450-1472] 3'UTR |
| 1042 | ACGGUGUUGUUUUAGAUGCCUUU | AAAGGCAUCUAAAACAACACCGU | | [1448-1470] 3'UTR |
| 1043 | UAAGUGAUUUGACUACUGGGAU | AUCCCAGUAGUCAAAUCACUUA | Dog, Chimp | [289-311] ORF |
| 1044 | GGUGAUGGCUUAUGGAAGGCUGU | ACAGCCUUCCAUAAGCCAUCACC | | [2499-2521] 3'UTR |
| 1045 | UGGUGAUGGCUUAUGGAAGGCUG | CAGCCUUCCAUAAGCCAUCACCA | | [2498-2520] 3'UTR |
| 1046 | AUGGUGAUGGCUUAUGGAAGGCU | AGCCUUCCAUAAGCCAUCACCAU | | [2497-2519] 3'UTR |
| 1047 | AUUGUCAAGGGUAGUAGCUGUAU | AUACAGCUACUACCCUUGACAAU | | [1764-1786] 3'UTR |

TABLE E-continued additional 23 mers

| Number | Sense siRNA | AntiSense siRNA | Other Sp | Hum-34222182 ORF: 204-785 |
|---|---|---|---|---|
| 1048 | AAUUGUCAAGGGUAGUAGCUGUA | UACAGCUACUACCCUUGACAAUU | | [1763-1785] 3'UTR |
| 1049 | CAAUUGUCAAGGGUAGUAGCUGU | ACAGCUACUACCCUUGACAAUUG | | [1762-1784] 3'UTR |
| 1050 | CGCUUCUCCUCUGGUUUCAGGAG | CUCCUGAAACCAGAGGAGAAGCG | | [678-700] ORF |
| 1051 | UCGCUUCUCCUCUGGUUUCAGGA | UCCUGAAACCAGAGGAGAAGCGA | | [677-699] ORF |
| 1052 | GUCGCUUCUCCUCUGGUUUCAGG | CCUGAAACCAGAGGAGAAGCGAC | | [676-698] ORF |
| 1053 | GGUCGCUUCUCCUCUGGUUUCAG | CUGAAACCAGAGGAGAAGCGACC | | [675-697] ORF |
| 1054 | AGGUCGCUUCUCCUCUGGUUUCA | UGAAACCAGAGGAGAAGCGACCU | | [674-696] ORF |
| 1055 | AUCAAUGUUGUUUUGCAUGUCUA | UAGACAUGCAAAACAACAUUGAU | | [2324-2346] 3'UTR |
| 1056 | UUCUAGCGUCGUACCUACUUUUG | CAAAAGUAGGUACGACGCUAGAA | | [584-606] ORF |
| 1057 | AUUCUAGCGUCGUACCUACUUUU | AAAAGUAGGUACGACGCUAGAAU | | [583-605] ORF |
| 1058 | CCAGAUAACCAUGCAUGCACCCA | UGGGUGCAUGCAUGGUUAUCUGG | | [1885-1907] 3'UTR |
| 1059 | UCCAGAUAACCAUGCAUGCACCC | GGGUGCAUGCAUGGUUAUCUGGA | | [1884-1906] 3'UTR |
| 1060 | GUCCAGAUAACCAUGCAUGCACC | GGUGCAUGCAUGGUUAUCUGGAC | | [1883-1905] 3'UTR |
| 1061 | CGUCCAGAUAACCAUGCAUGCAC | GUGCAUGCAUGGUUAUCUGGACG | | [1882-1904] 3'UTR |
| 1062 | CUUCCAAAAGCCCACACCACCAG | CUGGUGGUGUGGGCUUUUGGAAG | | [1229-1251] 3'UTR |
| 1063 | ACUUCCAAAAGCCCACACCACCA | UGGUGGUGUGGGCUUUUGGAAGU | | [1228-1250] 3'UTR |
| 1064 | AACUUCCAAAAGCCCACACCACC | GGUGGUGUGGGCUUUUGGAAGUU | | [1227-1249] 3'UTR |
| 1065 | AAACUUCCAAAAGCCCACACCAC | GUGGUGUGGGCUUUUGGAAGUUU | | [1226-1248] 3'UTR |
| 1066 | AAAACUUCCAAAAGCCCACACCA | UGGUGUGGGCUUUUGGAAGUUUU | | [1225-1247] 3'UTR |
| 1067 | AGUUAUCUUUGACUCUCUUGCCU | AGGCAAGAGAGUCAAAGAUAACU | | [2460-2482] 3'UTR |
| 1068 | CUUAAGUGUUGAAUACUGUCUUU | AAAGACAGUAUUCAACACUUAAG | | [1492-1514] 3'UTR |
| 1069 | UCUUAAGUGUUGAAUACUGUCUU | AAGACAGUAUUCAACACUUAAGA | | [1491-1513] 3'UTR |
| 1070 | UUCUUAAGUGUUGAAUACUGUCU | AGACAGUAUUCAACACUUAAGAA | | [1490-1512] 3'UTR |
| 1071 | GUUCUUAAGUGUUGAAUACUGUC | GACAGUAUUCAACACUUAAGAAC | | [1489-1511] 3'UTR |
| 1072 | UGUUCUUAAGUGUUGAAUACUGU | ACAGUAUUCAACACUUAAGAACA | | [1488-1510] 3'UTR |
| 1073 | CAUAGCAACUGCAGCUAACAGGC | GCCUGUUAGCUGCAGUUGCUAUG | | [927-949] 3'UTR |
| 1074 | UCAUAGCAACUGCAGCUAACAGG | CCUGUUAGCUGCAGUUGCUAUGA | | [926-948] 3'UTR |
| 1075 | UUCAUAGCAACUGCAGCUAACAG | CUGUUAGCUGCAGUUGCUAUGAA | | [925-947] 3'UTR |
| 1076 | AUUCAUAGCAACUGCAGCUAACA | UGUUAGCUGCAGUUGCUAUGAAU | | [924-946] 3'UTR |
| 1077 | CAUUCAUAGCAACUGCAGCUAAC | GUUAGCUGCAGUUGCUAUGAAUG | | [923-945] 3'UTR |
| 1078 | GAACCCGGCCAGCAUUUCAGAAU | AUUCUGAAAUGCUGGCCGGGUUC | Chimp | [233-255] ORF |
| 1079 | GGCCAAGAUAAAUCAAUGUUGUU | AACAACAUUGAUUUAUCUUGGCC | | [2313-2335] 3'UTR |
| 1080 | AUAUUACGGCAAUAAUGGAACUG | CAGUUCCAUUAUUGCCGUAAUAU | | [1347-1369] 3'UTR |
| 1081 | AAUAUUACGGCAAUAAUGGAACU | AGUUCCAUUAUUGCCGUAAUAUU | | [1346-1368] 3'UTR |
| 1082 | AAAUAUUACGGCAAUAAUGGAAC | GUUCCAUUAUUGCCGUAAUAUUU | | [1345-1367] 3'UTR |
| 1083 | GAAAUAUUACGGCAAUAAUGGAA | UUCCAUUAUUGCCGUAAUAUUUC | | [1344-1366] 3'UTR |
| 1084 | AGAAAUAUUACGGCAAUAAUGGA | UCCAUUAUUGCCGUAAUAUUUCU | | [1343-1365] 3'UTR |

TABLE E-continued additional 23 mers

| Number | Sense siRNA | AntiSense siRNA | Other Sp | Hum-34222182 ORF: 204-785 |
|---|---|---|---|---|
| 1085 | UAAAAAGCUGGAUAGGAUUGUGU | ACACAAUCCUAUCCAGCUUUUUA | Chin, GP, Chimp, Rat | [557-579] ORF |
| 1086 | AUGUUGUUCCUGAACCCAACCUC | GAGGUUGGGUUCAGGAACAACAU | Chimp | [313-335] ORF |
| 1087 | UAUGUUGUUCCUGAACCCAACCU | AGGUUGGGUUCAGGAACAACAUA | Chimp | [312-334] ORF |
| 1088 | UUAUGUUGUUCCUGAACCCAACC | GGUUGGGUUCAGGAACAACAUAA | Chimp | [311-333] ORF |
| 1089 | AUUAUGUUGUUCCUGAACCCAAC | GUUGGGUUCAGGAACAACAUAAU | Chimp | [310-332] ORF |
| 1090 | GAUUAUGUUGUUCCUGAACCCAA | UUGGGUUCAGGAACAACAUAAUC | Chimp | [309-331] ORF |
| 1091 | GGUUUCAGGAGAACUCUGAUCCU | AGGAUCAGAGUUCUCCUGAAACC | | [690-712] ORF |
| 1092 | UGGUUUCAGGAGAACUCUGAUCC | GGAUCAGAGUUCUCCUGAAACCA | | [689-711] ORF |
| 1093 | CUGGUUUCAGGAGAACUCUGAUC | GAUCAGAGUUCUCCUGAAACCAG | | [688-710] ORF |
| 1094 | UCUGGUUUCAGGAGAACUCUGAU | AUCAGAGUUCUCCUGAAACCAGA | | [687-709] ORF |
| 1095 | CUCUGGUUUCAGGAGAACUCUGA | UCAGAGUUCUCCUGAAACCAGAG | | [686-708] ORF |
| 1096 | CCAUGGUUGCAACUGGCAGUUUG | CAAACUGCCAGUUGCAACCAUGG | Chimp | [202-224] 5'UTR + ORF |
| 1097 | ACCAUGGUUGCAACUGGCAGUUU | AAACUGCCAGUUGCAACCAUGGU | Chimp | [201-223] 5'UTR + ORF |
| 1098 | GACCAUGGUUGCAACUGGCAGUU | AACUGCCAGUUGCAACCAUGGUC | Chimp | [200-222] 5'UTR + ORF |
| 1099 | UGACCAUGGUUGCAACUGGCAGU | ACUGCCAGUUGCAACCAUGGUCA | Chimp | [199-221] 5'UTR + ORF |
| 1100 | UGUGAUCCUGUUACUGAUACUAU | AUAGUAUCAGUAACAGGAUCACA | | [2189-2211] 3'UTR |
| 1101 | AUUAUUUCAUGAUUGGGUAGUAA | UUACUACCCAAUCAUGAAAUAAU | | [805-827] 3'UTR |
| 1102 | GUUUUUAGACAGGAAGGUAGGAU | AUCCUACCUUCCUGUCUAAAAAC | | [1273-1295] 3'UTR |
| 1103 | GGUUUUUAGACAGGAAGGUAGGA | UCCUACCUUCCUGUCUAAAAACC | | [1272-1294] 3'UTR |
| 1104 | GGGUUUUUAGACAGGAAGGUAGG | CCUACCUUCCUGUCUAAAAACCC | | [1271-1293] 3'UTR |
| 1105 | AGGGUUUUUAGACAGGAAGGUAG | CUACCUUCCUGUCUAAAAACCCU | | [1270-1292] 3'UTR |
| 1106 | AGGUUUCCUGCCCUAGCUAUUAG | CUAAUAGCUAGGGCAGGAAACCU | | [2098-2120] 3'UTR |
| 1107 | CAGGUUUCCUGCCCUAGCUAUUA | UAAUAGCUAGGGCAGGAAACCUG | | [2097-2119] 3'UTR |
| 1108 | UCAGGUUUCCUGCCCUAGCUAUU | AAUAGCUAGGGCAGGAAACCUGA | | [2096-2118] 3'UTR |
| 1109 | UUCAGGUUUCCUGCCCUAGCUAU | AUAGCUAGGGCAGGAAACCUGAA | | [2095-2117] 3'UTR |
| 1110 | AUUCAGGUUUCCUGCCCUAGCUA | UAGCUAGGGCAGGAAACCUGAAU | | [2094-2116] 3'UTR |
| 1111 | CAACAAUGUUCAAUUCAGCAAGG | CCUUGCUGAAUUGAACAUUGUUG | | [2033-2055] 3'UTR |
| 1112 | UCAACAAUGUUCAAUUCAGCAAG | CUUGCUGAAUUGAACAUUGUUGA | | [2032-2054] 3'UTR |
| 1113 | CUCAACAAUGUUCAAUUCAGCAA | UUGCUGAAUUGAACAUUGUUGAG | | [2031-2053] 3'UTR |
| 1114 | ACUCAACAAUGUUCAAUUCAGCA | UGCUGAAUUGAACAUUGUUGAGU | | [2030-2052] 3'UTR |
| 1115 | CACUCAACAAUGUUCAAUUCAGC | GCUGAAUUGAACAUUGUUGAGUG | | [2029-2051] 3'UTR |
| 1116 | CCUCUUUUCAGUAUUACAUGUGC | GCACAUGUAAUACUGAAAAGAGG | | [1655-1677] 3'UTR |
| 1117 | UCCUCUUUUCAGUAUUACAUGUG | CACAUGUAAUACUGAAAAGAGGA | | [1654-1676] 3'UTR |
| 1118 | AUCCUCUUUUCAGUAUUACAUGU | ACAUGUAAUACUGAAAAGAGGAU | | [1653-1675] 3'UTR |
| 1119 | UAUCCUCUUUUCAGUAUUACAUG | CAUGUAAUACUGAAAAGAGGAUA | | [1652-1674] 3'UTR |
| 1120 | CUAUCCUCUUUUCAGUAUUACAU | AUGUAAUACUGAAAAGAGGAUAG | | [1651-1673] 3'UTR |
| 1121 | AGUGUUGAAUACUGUCUUUAAAC | GUUUAAAGACAGUAUUCAACACU | | [1496-1518] 3'UTR |

TABLE E-continued additional 23 mers

| Number | Sense siRNA | AntiSense siRNA | Other Sp | Hum-34222182 ORF: 204-785 |
|---|---|---|---|---|
| 1122 | AAGUGUUGAAUACUGUCUUUAAA | UUUAAAGACAGUAUUCAACACUU | | [1495-1517] 3'UTR |
| 1123 | UAAGUGUUGAAUACUGUCUUUAA | UUAAAGACAGUAUUCAACACUUA | | [1494-1516] 3'UTR |
| 1124 | UUAAGUGUUGAAUACUGUCUUUA | UAAAGACAGUAUUCAACACUUAA | | [1493-1515] 3'UTR |
| 1125 | GAACAACAGUGAUUGAAGGGUCC | GGACCCUUCAAUCACUGUUGUUC | | [760-782] ORF |
| 1126 | UCUAUCCUCUUUUCAGUAUUACA | UGUAAUACUGAAAAGAGGAUAGA | | [1650-1672] 3'UTR |
| 1127 | GGAAAUUAGUUCUGAGAUCUAGU | ACUAGAUCUCAGAACUAAUUUCC | | [1605-1627] 3'UTR |
| 1128 | AGGAAAUUAGUUCUGAGAUCUAG | CUAGAUCUCAGAACUAAUUUCCU | | [1604-1626] 3'UTR |
| 1129 | UAGGAAAUUAGUUCUGAGAUCUA | UAGAUCUCAGAACUAAUUUCCUA | | [1603-1625] 3'UTR |
| 1130 | AUAGGAAAUUAGUUCUGAGAUCU | AGAUCUCAGAACUAAUUUCCUAU | | [1602-1624] 3'UTR |
| 1131 | UUGUCCUUUUUCCACUAACAGUU | AACUGUUAGUGGAAAAGGACAA | | [2441-2463] 3'UTR |
| 1132 | UUUUCUGGCCUUUGGAGAAGUGA | UCACUUCUCCAAAGGCCAGAAAA | | [953-975] 3'UTR |
| 1133 | AUUUUCUGGCCUUUGGAGAAGUG | CACUUCUCCAAAGGCCAGAAAAU | | [952-974] 3'UTR |
| 1134 | GAUUUUCUGGCCUUUGGAGAAGU | ACUUCUCCAAAGGCCAGAAAAUC | | [951-973] 3'UTR |
| 1135 | AGUCCUCUCUGAUUCACUUAGU | ACUAAGUGAAUCAGAGAGGGACU | | [1625-1647] 3'UTR |
| 1136 | UAGUCCCUCUCUGAUUCACUUAG | CUAAGUGAAUCAGAGAGGGACUA | | [1624-1646] 3'UTR |
| 1137 | CUAGUCCCUCUCUGAUUCACUUA | UAAGUGAAUCAGAGAGGGACUAG | | [1623-1645] 3'UTR |
| 1138 | UCUAGUCCCUCUCUGAUUCACUU | AAGUGAAUCAGAGAGGGACUAGA | | [1622-1644] 3'UTR |
| 1139 | UCUUUAUAGAAUUGGGCCAAGAU | AUCUUGGCCCAAUUCUAUAAAGA | | [2299-2321] 3'UTR |
| 1140 | GUUUCAGGAGAACUCUGAUCCUC | GAGGAUCAGAGUUCUCCUGAAAC | | [691-713] ORF |
| 1141 | CCUAGCUAUUAGCUCCACUUCAC | GUGAAGUGGAGCUAAUAGCUAGG | | [2109-2131] 3'UTR |
| 1142 | ACUCAAAUUUGAAGGGUUUUUAG | CUAAAACCCUUCAAAUUUGAGU | | [1258-1280] 3'UTR |
| 1143 | CUAACAGGCUGAUUUUCUGGCCU | AGGCCAGAAAAUCAGCCUGUUAG | | [941-963] 3'UTR |
| 1144 | GCUAACAGGCUGAUUUUCUGGCC | GGCCAGAAAAUCAGCCUGUUAGC | | [940-962] 3'UTR |
| 1145 | AGCUAACAGGCUGAUUUUCUGGC | GCCAGAAAAUCAGCCUGUUAGCU | | [939-961] 3'UTR |
| 1146 | CAGCUAACAGGCUGAUUUUCUGG | CCAGAAAAUCAGCCUGUUAGCUG | | [938-960] 3'UTR |
| 1147 | GCAGCUAACAGGCUGAUUUUCUG | CAGAAAAUCAGCCUGUUAGCUGC | | [937-959] 3'UTR |
| 1148 | CAAUGUUCAAUUCAGCAAGGCUU | AAGCCUUGCUGAAUUGAACAUUG | | [2036-2058] 3'UTR |
| 1149 | ACAAUGUUCAAUUCAGCAAGGCU | AGCCUUGCUGAAUUGAACAUUGU | | [2035-2057] 3'UTR |
| 1150 | AACAAUGUUCAAUUCAGCAAGGC | GCCUUGCUGAAUUGAACAUUGUU | | [2034-2056] 3'UTR |
| 1151 | UGGUGUUACUGAAAAACAGGUGU | ACACCUGUUUUUCAGUAACACCA | | [2169-2191] 3'UTR |
| 1152 | CUGGUGUUACUGAAAAACAGGUG | CACCUGUUUUUCAGUAACACCAG | | [2168-2190] 3'UTR |
| 1153 | CCUGGUGUUACUGAAAAACAGGU | ACCUGUUUUUCAGUAACACCAGG | | [2167-2189] 3'UTR |
| 1154 | GUUCCUGAACCCAACCUCAACGA | UCGUUGAGGUUGGGUUCAGGAAC | Chimp | [318-340] ORF |
| 1155 | UGUUCCUGAACCCAACCUCAACG | CGUUGAGGUUGGGUUCAGGAACA | Chimp | [317-339] ORF |
| 1156 | UUGUUCCUGAACCCAACCUCAAC | GUUGAGGUUGGGUUCAGGAACAA | Chimp | [316-338] ORF |
| 1157 | GUUGUUCCUGAACCCAACCUCAA | UUGAGGUUGGGUUCAGGAACAAC | Chimp | [315-337] ORF |
| 1158 | UGUUGUUCCUGAACCCAACCUCA | UGAGGUUGGGUUCAGGAACAACA | Chimp | [314-336] ORF |

TABLE E-continued additional 23 mers

| Number | Sense siRNA | AntiSense siRNA | Other Sp | Hum-34222182 ORF: 204-785 | |
|---|---|---|---|---|---|
| 1159 | UUUCAGGAGAACUCUGAUCCUCA | UGAGGAUCAGAGUUCUCCUGAAA | | [692-714] | ORF |
| 1160 | CAACUUGCCAGAAUUUGGUUAAA | UUUAACCAAAUUCUGGCAAGUUG | Chimp | [358-380] | ORF |
| 1161 | UGCAGCUAACAGGCUGAUUUUCU | AGAAAAUCAGCCUGUUAGCUGCA | | [936-958] | 3'UTR |
| 1162 | CUGCAGCUAACAGGCUGAUUUUC | GAAAAUCAGCCUGUUAGCUGCAG | | [935-957] | 3'UTR |
| 1163 | ACUGCAGCUAACAGGCUGAUUUU | AAAAUCAGCCUGUUAGCUGCAGU | | [934-956] | 3'UTR |
| 1164 | CCCAAAUGUAGUCUCUUUUCUUU | AAAGAAAAGAGACUACAUUUGGG | | [890-912] | 3'UTR |
| 1165 | CCCCAAAUGUAGUCUCUUUUCUU | AAGAAAAGAGACUACAUUUGGGG | | [889-911] | 3'UTR |
| 1166 | ACCCCAAAUGUAGUCUCUUUUCU | AGAAAAGAGACUACAUUUGGGGU | | [888-910] | 3'UTR |
| 1167 | AACCCCAAAUGUAGUCUCUUUUC | GAAAAGAGACUACAUUUGGGGUU | | [887-909] | 3'UTR |
| 1168 | AAACCCCAAAUGUAGUCUCUUUU | AAAAGAGACUACAUUUGGGGUUU | | [886-908] | 3'UTR |
| 1169 | ACCAUGCAUGCACCCAGAUUUUU | AAAAAUCUGGGUGCAUGCAUGGU | | [1892-1914] | 3'UTR |
| 1170 | GGAACUGCUUCACUGUUUCUUGG | CCAAGAAACAGUGAAGCAGUUCC | | [1363-1385] | 3'UTR |
| 1171 | UGGAACUGCUUCACUGUUUCUUG | CAAGAAACAGUGAAGCAGUUCCA | | [1362-1384] | 3'UTR |
| 1172 | AUGGAACUGCUUCACUGUUUCUU | AAGAAACAGUGAAGCAGUUCCAU | | [1361-1383] | 3'UTR |
| 1173 | AAUGGAACUGCUUCACUGUUUCU | AGAAACAGUGAAGCAGUUCCAUU | | [1360-1382] | 3'UTR |
| 1174 | UAAUGGAACUGCUUCACUGUUUC | GAAACAGUGAAGCAGUUCCAUUA | | [1359-1381] | 3'UTR |
| 1175 | CCAAAGGUUCACUGUGUUUCUGC | GCAGAAACACAGUGAACCUUUGG | | [2357-2379] | 3'UTR |
| 1176 | UCCAAAGGUUCACUGUGUUUCUG | CAGAAACACAGUGAACCUUUGGA | | [2356-2378] | 3'UTR |
| 1177 | CUCCAAAGGUUCACUGUGUUUCU | AGAAACACAGUGAACCUUUGGAG | | [2355-2377] | 3'UTR |
| 1178 | GCUCCAAAGGUUCACUGUGUUUC | GAAACACAGUGAACCUUUGGAGC | | [2354-2376] | 3'UTR |
| 1179 | AGCUCCAAAGGUUCACUGUGUUU | AAACACAGUGAACCUUUGGAGCU | | [2353-2375] | 3'UTR |
| 1180 | GAACCAUUUCACCAUGGCAGUGU | ACACUGCCAUGGUGAAAUGGUUC | | [1690-1712] | 3'UTR |
| 1181 | UGAACCAUUUCACCAUGGCAGUG | CACUGCCAUGGUGAAAUGGUUCA | | [1689-1711] | 3'UTR |
| 1182 | AUGAACCAUUUCACCAUGGCAGU | ACUGCCAUGGUGAAAUGGUUCAU | | [1688-1710] | 3'UTR |
| 1183 | GAUGAACCAUUUCACCAUGGCAG | CUGCCAUGGUGAAAUGGUUCAUC | | [1687-1709] | 3'UTR |
| 1184 | ACUAAACUUGGUUGCUCAAAGGU | ACCUUUGAGCAACCAAGUUUAGU | Chimp | [414-436] | ORF |
| 1185 | AACUAAACUUGGUUGCUCAAAGG | CCUUUGAGCAACCAAGUUUAGUU | Chimp | [413-435] | ORF |
| 1186 | AAACUAAACUUGGUUGCUCAAAG | CUUUGAGCAACCAAGUUUAGUUU | Chimp | [412-434] | ORF |
| 1187 | CAAACUAAACUUGGUUGCUCAAA | UUUGAGCAACCAAGUUUAGUUUG | Chimp | [411-433] | ORF |
| 1188 | GCAAACUAAACUUGGUUGCUCAA | UUGAGCAACCAAGUUUAGUUUGC | Chimp | [410-432] | ORF |
| 1189 | AUUUUCUGCAUAGAUCCCAUUUU | AAAUGGGAUCUAUGCAGAAAAU | | [991-1013] | 3'UTR |
| 1190 | GAUUUUCUGCAUAGAUCCCAUUU | AAAUGGGAUCUAUGCAGAAAAUC | | [990-1012] | 3'UTR |
| 1191 | AGAUUUUCUGCAUAGAUCCCAUU | AAUGGGAUCUAUGCAGAAAAUCU | | [989-1011] | 3'UTR |
| 1192 | UAGAUUUUCUGCAUAGAUCCCAU | AUGGGAUCUAUGCAGAAAAUCUA | | [988-1010] | 3'UTR |
| 1193 | AUUUACGAAGUCUGCAUUGGCUA | UAGCCAAUGCAGACUUCGUAAAU | | [1817-1839] | 3'UTR |
| 1194 | GAUCAUUAUCUCUUUCCUUUUUU | AAAAAGGAAAGAGAUAAUGAUC | | [1982-2004] | 3'UTR |
| 1195 | AGAUCAUUAUCUCUUUCCUUUUU | AAAAAGGAAAGAGAUAAUGAUCU | | [1981-2003] | 3'UTR |

TABLE E-continued additional 23 mers

| Number | Sense siRNA | AntiSense siRNA | Other Sp | Hum-34222182 ORF: 204-785 |
|---|---|---|---|---|
| 1196 | UAGAUCAUUAUCUCUUUCCUUUU | AAAAGGAAAGAGAUAAUGAUCUA | | [1980-2002] 3'UTR |
| 1197 | GUAGAUCAUUAUCUCUUUCCUUU | AAAGGAAAGAGAUAAUGAUCUAC | | [1979-2001] 3'UTR |
| 1198 | AGUAGAUCAUUAUCUCUUUCCUU | AAGGAAAGAGAUAAUGAUCUACU | | [1978-2000] 3'UTR |
| 1199 | GCAUUGGCUAUGGAGAUAUGGUU | AACCAUAUCUCCAUAGCCAAUGC | | [1830-1852] 3'UTR |
| 1200 | GGUAGUAGCUGUAUACUACCACU | AGUGGUAGUAUACAGCUACUACC | | [1773-1795] 3'UTR |
| 1201 | CCAAUUGUCAAGGGUAGUAGCUG | CAGCUACUACCCUUGACAAUUGG | | [1761-1783] 3'UTR |
| 1202 | CCCAAUUGUCAAGGGUAGUAGCU | AGCUACUACCCUUGACAAUUGGG | | [1760-1782] 3'UTR |
| 1203 | CCCCAAUUGUCAAGGGUAGUAGC | GCUACUACCCUUGACAAUUGGGG | | [1759-1781] 3'UTR |
| 1204 | ACCCCAAUUGUCAAGGGUAGUAG | CUACUACCCUUGACAAUUGGGGU | | [1758-1780] 3'UTR |
| 1205 | AACCCCAAUUGUCAAGGGUAGUA | UACUACCCUUGACAAUUGGGGUU | | [1757-1779] 3'UTR |
| 1206 | CUUAGUAAUCUAUCCUCUUUUCA | UGAAAGAGGAUAGAUUACUAAG | | [1642-1664] 3'UTR |
| 1207 | ACUUAGUAAUCUAUCCUCUUUUC | GAAAAGAGGAUAGAUUACUAAGU | | [1641-1663] 3'UTR |
| 1208 | CACUUAGUAAUCUAUCCUCUUUU | AAAAGAGGAUAGAUUACUAAGUG | | [1640-1662] 3'UTR |
| 1209 | UCACUUAGUAAUCUAUCCUCUUU | AAAGAGGAUAGAUUACUAAGUGA | | [1639-1661] 3'UTR |
| 1210 | UUCACUUAGUAAUCUAUCCUCUU | AAGAGGAUAGAUUACUAAGUGAA | | [1638-1660] 3'UTR |
| 1211 | CUGGAGUUGUCACCACUGACUGG | CCAGUCAGUGGUGACAACUCCAG | | [2387-2409] 3'UTR |
| 1212 | CCUGGAGUUGUCACCACUGACUG | CAGUCAGUGGUGACAACUCCAGG | | [2386-2408] 3'UTR |
| 1213 | UCCUGGAGUUGUCACCACUGACU | AGUCAGUGGUGACAACUCCAGGA | | [2385-2407] 3'UTR |
| 1214 | GUCCUGGAGUUGUCACCACUGAC | GUCAGUGGUGACAACUCCAGGAC | | [2384-2406] 3'UTR |
| 1215 | UGUCCUGGAGUUGUCACCACUGA | UCAGUGGUGACAACUCCAGGACA | | [2383-2405] 3'UTR |
| 1216 | CAGUUUGAGCAGCAAGAACCCGG | CCGGGUUCUUGCUGCUCAAACUG | Chimp | [218-240] ORF |
| 1217 | CUACUGGGAUUAUGUUGUUCCUG | CAGGAACAACAUAAUCCCAGUAG | Chimp | [302-324] ORF |
| 1218 | ACUACUGGGAUUAUGUUGUUCCU | AGGAACAACAUAAUCCCAGUAGU | Chimp | [301-323] ORF |
| 1219 | GACUACUGGGAUUAUGUUGUUCC | GGAACAACAUAAUCCCAGUAGUC | Chimp | [300-322] ORF |
| 1220 | UGACUACUGGGAUUAUGUUGUUC | GAACAACAUAAUCCCAGUAGUCA | Chimp | [299-321] ORF |
| 1221 | UUGACUACUGGGAUUAUGUUGUU | AACAACAUAAUCCCAGUAGUCAA | Chimp | [298-320] ORF |
| 1222 | UAGGGACAGAUGUAUUCAUCCUG | CAGGAUGAAUACAUCUGUCCCUA | | [2148-2170] 3'UTR |
| 1223 | GUAGGGACAGAUGUAUUCAUCCU | AGGAUGAAUACAUCUGUCCCUAC | | [2147-2169] 3'UTR |
| 1224 | CGUAGGGACAGAUGUAUUCAUCC | GGAUGAAUACAUCUGUCCCUACG | | [2146-2168] 3'UTR |
| 1225 | CAAUCUUUAUAGAAUUGGGCCAA | UUGGCCCAAUUCUAUAAAGAUUG | | [2296-2318] 3'UTR |
| 1226 | CCAAUCUUUAUAGAAUUGGGCCA | UGGCCCAAUUCUAUAAAGAUUGG | | [2295-2317] 3'UTR |
| 1227 | GCCAAUCUUUAUAGAAUUGGGCC | GGCCCAAUUCUAUAAAGAUUGGC | | [2294-2316] 3'UTR |
| 1228 | AGCCAAUCUUUAUAGAAUUGGGC | GCCCAAUUCUAUAAAGAUUGGCU | | [2293-2315] 3'UTR |
| 1229 | AAGCCAAUCUUUAUAGAAUUGGG | CCCAAUUCUAUAAAGAUUGGCUU | | [2292-2314] 3'UTR |
| 1230 | GUUGUCCUUUUUCCACUAACAGU | ACUGUUAGUGGAAAAAGGACAAC | | [2440-2462] 3'UTR |
| 1231 | GUCCUAAAAAGGGAAAAUAUAUA | UAUAUAUUUUCCCUUUUUAGGAC | | [779-801] ORF + 3'UTR |
| 1232 | AUUUAGCCUAUCAAAACUUCCAA | UUGGAAGUUUUGAUAGGCUAAAU | | [1213-1235] 3'UTR |

TABLE E-continued additional 23 mers

| Number | Sense siRNA | AntiSense siRNA | Other Sp | Hum-34222182 ORF: 204-785 |
|---|---|---|---|---|
| 1233 | CUAAACUCUUCAAAUGCUUGGAA | UUCCAAGCAUUUGAAGAGUUUAG | | [2259-2281] 3'UTR |
| 1234 | ACUAAACUCUUCAAAUGCUUGGA | UCCAAGCAUUUGAAGAGUUUAGU | | [2258-2280] 3'UTR |
| 1235 | AACUAAACUCUUCAAAUGCUUGG | CCAAGCAUUUGAAGAGUUUAGUU | | [2257-2279] 3'UTR |
| 1236 | AAACUAAACUCUUCAAAUGCUUG | CAAGCAUUUGAAGAGUUUAGUUU | | [2256-2278] 3'UTR |
| 1237 | CAAACUAAACUCUUCAAAUGCUU | AAGCAUUUGAAGAGUUUAGUUUG | | [2255-2277] 3'UTR |
| 1238 | UGCGAGGUUGUGUUAUGCACGUG | CACGUGCAUAACACAACCUCGCA | | [511-533] ORF |
| 1239 | UUGCGAGGUUGUGUUAUGCACGU | ACGUGCAUAACACAACCUCGCAA | | [510-532] ORF |
| 1240 | UCAACUUGCCAGAAUUUGGUUAA | UUAACCAAAUUCUGGCAAGUUGA | Chimp | [357-379] ORF |
| 1241 | CAAAAGCUUGUGGUGCCAUUUCA | UGAAAUGGCACCACAAGCUUUUG | | [1419-1441] 3'UTR |
| 1242 | ACAAAAGCUUGUGGUGCCAUUUC | GAAAUGGCACCACAAGCUUUUGU | | [1418-1440] 3'UTR |
| 1243 | AACAAAAGCUUGUGGUGCCAUUU | AAAUGGCACCACAAGCUUUUGUU | | [1417-1439] 3'UTR |
| 1244 | CAACAAAAGCUUGUGGUGCCAUU | AAUGGCACCACAAGCUUUUGUUG | | [1416-1438] 3'UTR |
| 1245 | GCAAGGCUUUCAUAUCCUUGCUG | CAGCAAGGAUAUGAAAGCCUUGC | | [2050-2072] 3'UTR |
| 1246 | AGCAAGGCUUUCAUAUCCUUGCU | AGCAAGGAUAUGAAAGCCUUGCU | | [2049-2071] 3'UTR |
| 1247 | CAGCAAGGCUUUCAUAUCCUUGC | GCAAGGAUAUGAAAGCCUUGCUG | | [2048-2070] 3'UTR |
| 1248 | UCAGCAAGGCUUUCAUAUCCUUG | CAAGGAUAUGAAAGCCUUGCUGA | | [2047-2069] 3'UTR |
| 1249 | UUCAGCAAGGCUUUCAUAUCCUU | AAGGAUAUGAAAGCCUUGCUGAA | | [2046-2068] 3'UTR |
| 1250 | AAGAUACUACAAAGCCAAUCUUU | AAAGAUUGGCUUUGUAGUAUCUU | | [2281-2303] 3'UTR |
| 1251 | UCAGCUCAGGAUUUCGACUUGUU | AACAAGUCGAAAUCCUGAGCUGA | | [712-734] ORF |
| 1252 | GCAGUGUUAUCUCAUCUCUGGGC | GCCCAGAGAUGAGAUAACACUGC | | [1706-1728] 3'UTR |
| 1253 | GGCAGUGUUAUCUCAUCUCUGGG | CCCAGAGAUGAGAUAACACUGCC | | [1705-1727] 3'UTR |
| 1254 | UGGCAGUGUUAUCUCAUCUCUGG | CCAGAGAUGAGAUAACACUGCCA | | [1704-1726] 3'UTR |
| 1255 | AUGGCAGUGUUAUCUCAUCUCUG | CAGAGAUGAGAUAACACUGCCAU | | [1703-1725] 3'UTR |
| 1256 | CAUGGCAGUGUUAUCUCAUCUCU | AGAGAUGAGAUAACACUGCCAUG | | [1702-1724] 3'UTR |
| 1257 | AUCUUUAUAGAAUUGGGCCAAGA | UCUUGGCCCAAUUCUAUAAAGAU | | [2298-2320] 3'UTR |
| 1258 | AAUCUUUAUAGAAUUGGGCCAAG | CUUGGCCCAAUUCUAUAAAGAUU | | [2297-2319] 3'UTR |
| 1259 | CCCAUUUUUGUACAGAAUUGAAU | AUUCAAUUCUGUACAAAAUGGG | | [1006-1028] 3'UTR |
| 1260 | UCCCAUUUUUGUACAGAAUUGAA | UUCAAUUCUGUACAAAAUGGGA | | [1005-1027] 3'UTR |
| 1261 | AUCCCAUUUUUGUACAGAAUUGA | UCAAUUCUGUACAAAAUGGGAU | | [1004-1026] 3'UTR |
| 1262 | GAUCCCAUUUUUGUACAGAAUUG | CAAUUCUGUACAAAAUGGGAUC | | [1003-1025] 3'UTR |
| 1263 | AGAUCCCAUUUUUGUACAGAAUU | AAUUCUGUACAAAAUGGGAUCU | | [1002-1024] 3'UTR |
| 1264 | GUGUGUAGUUGAUUACUCUUCCA | UGGAAGAGUAAUCAACUACACAC | | [1552-1574] 3'UTR |
| 1265 | UGUGUGUAGUUGAUUACUCUUCC | GGAAGAGUAAUCAACUACACACA | | [1551-1573] 3'UTR |
| 1266 | UUGUGUGUAGUUGAUUACUCUUC | GAAGAGUAAUCAACUACACACAA | | [1550-1572] 3'UTR |
| 1267 | UUUGUGUGUAGUUGAUUACUCUU | AAGAGUAAUCAACUACACACAAA | | [1549-1571] 3'UTR |
| 1268 | UUUUGUGUGUAGUUGAUUACUCU | AGAGUAAUCAACUACACACAAAA | | [1548-1570] 3'UTR |
| 1269 | GUAAAUGAGAAAUAUUACGGCAA | UUGCCGUAAUAUUUCUCAUUUAC | | [1336-1358] 3'UTR |

TABLE E-continued additional 23 mers

| Number | Sense siRNA | AntiSense siRNA | Other Sp | Hum-34222182 ORF: 204-785 |
|---|---|---|---|---|
| 1270 | AUGCACCCAGAUUUUUUCCACCU | AGGUGGAAAAAAUCUGGGUGCAU | | [1899-1921] 3'UTR |
| 1271 | CAUGCACCCAGAUUUUUUCCACC | GGUGGAAAAAAUCUGGGUGCAUG | | [1898-1920] 3'UTR |
| 1272 | UAGAUCCCAUUUUUGUACAGAAU | AUUCUGUACAAAAAUGGGAUCUA | | [1001-1023] 3'UTR |
| 1273 | AUAGAUCCCAUUUUUGUACAGAA | UUCUGUACAAAAAUGGGAUCUAU | | [1000-1022] 3'UTR |
| 1274 | CAGAAUUGCUGGACUGUGGCUAU | AUAGCCACAGUCCAGCAAUUCUG | Chimp | [250-272] ORF |
| 1275 | UCAGAAUUGCUGGACUGUGGCUA | UAGCCACAGUCCAGCAAUUCUGA | Chimp | [249-271] ORF |
| 1276 | UUCAGAAUUGCUGGACUGUGGCU | AGCCACAGUCCAGCAAUUCUGAA | Chimp | [248-270] ORF |
| 1277 | UUUCAGAAUUGCUGGACUGUGGC | GCCACAGUCCAGCAAUUCUGAAA | Chimp | [247-269] ORF |
| 1278 | AUUUCAGAAUUGCUGGACUGUGG | CCACAGUCCAGCAAUUCUGAAAU | Chimp | [246-268] ORF |
| 1279 | UUUGACUACUGGGAUUAUGUUGU | ACAACAUAAUCCCAGUAGUCAAA | Chimp | [297-319] ORF |
| 1280 | UUUUGACUACUGGGAUUAUGUUG | CAACAUAAUCCCAGUAGUCAAAA | Chimp | [296-318] ORF |
| 1281 | AUUUUGACUACUGGGAUUAUGUU | AACAUAAUCCCAGUAGUCAAAAU | Chimp | [295-317] ORF |
| 1282 | GAGAAUUGCUCAAGAUGUCCUGC | GCAGGACAUCUUGAGCAAUUCUC | Chimp, Ms | [461-483] ORF |
| 1283 | AGAGAAUUGCUCAAGAUGUCCUG | CAGGACAUCUUGAGCAAUUCUCU | Chimp, Ms | [460-482] ORF |
| 1284 | CAGAGAAUUGCUCAAGAUGUCCU | AGGACAUCUUGAGCAAUUCUCUG | Chimp, Ms | [459-481] ORF |
| 1285 | UGUAGAACUGUUGUCCUUUUUCC | GGAAAAGGACAACAGUUCUACA | | [2431-2453] 3'UTR |
| 1286 | AUGUAGAACUGUUGUCCUUUUUC | GAAAAGGACAACAGUUCUACAU | | [2430-2452] 3'UTR |
| 1287 | GAUGUAGAACUGUUGUCCUUUUU | AAAAGGACAACAGUUCUACAUC | | [2429-2451] 3'UTR |
| 1288 | CGAUGUAGAACUGUUGUCCUUUU | AAAGGACAACAGUUCUACAUCG | | [2428-2450] 3'UTR |
| 1289 | CCAUUUUGUACAGAAUUGAAUG | CAUUCAAUUCUGUACAAAAUGG | | [1007-1029] 3'UTR |
| 1290 | CUUAAUCUCAGAUGAACCAUUUC | GAAAUGGUUCAUCUGAGAUUAAG | | [1677-1699] 3'UTR |
| 1291 | GCUUAAUCUCAGAUGAACCAUUU | AAAUGGUUCAUCUGAGAUUAAGC | | [1676-1698] 3'UTR |
| 1292 | UGCUUAAUCUCAGAUGAACCAUU | AAUGGUUCAUCUGAGAUUAAGCA | | [1675-1697] 3'UTR |
| 1293 | GAAUUUGGUUAAAAUGCUGGAGA | UCUCCAGCAUUUUAACCAAAUUC | Chimp | [368-390] ORF |
| 1294 | AGAAUUUGGUUAAAAUGCUGGAG | CUCCAGCAUUUUAACCAAAUUCU | Chimp | [367-389] ORF |
| 1295 | CAGAAUUUGGUUAAAAUGCUGGA | UCCAGCAUUUUAACCAAAUUCUG | Chimp | [366-388] ORF |
| 1296 | CCAGAAUUUGGUUAAAAUGCUGG | CCAGCAUUUUAACCAAAUUCUGG | Chimp | [365-387] ORF |
| 1297 | UUUUUAGACAGGAAGGUAGGAUU | AAUCCUACCUUCCUGUCUAAAAA | | [1274-1296] 3'UTR |
| 1298 | UUGAAGUAUCUCUCCUUAACCCC | GGGGUUAAGGAGAGAUACUUCAA | | [1740-1762] 3'UTR |
| 1299 | AUUGAAGUAUCUCUCCUUAACCC | GGGUUAAGGAGAGAUACUUCAAU | | [1739-1761] 3'UTR |
| 1300 | AAUUGAAGUAUCUCUCCUUAACC | GGUUAAGGAGAGAUACUUCAAUU | | [1738-1760] 3'UTR |
| 1301 | GAAUUGAAGUAUCUCUCCUUAAC | GUUAAGGAGAGAUACUUCAAUUC | | [1737-1759] 3'UTR |
| 1302 | GGAAUUGAAGUAUCUCUCCUUAA | UUAAGGAGAGAUACUUCAAUUCC | | [1736-1758] 3'UTR |
| 1303 | CUUUGACUCUCUUGCCUGUUAUG | CAUAACAGGCAAGAGAGUCAAAG | | [2466-2488] 3'UTR |
| 1304 | UCUUUGACUCUCUUGCCUGUUAU | AUAACAGGCAAGAGAGUCAAAGA | | [2465-2487] 3'UTR |
| 1305 | AUCUUUGACUCUCUUGCCUGUUA | UAACAGGCAAGAGAGUCAAAGAU | | [2464-2486] 3'UTR |
| 1306 | UAUCUUUGACUCUCUUGCCUGUU | AACAGGCAAGAGAGUCAAAGAUA | | [2463-2485] 3'UTR |

TABLE E-continued additional 23 mers

| Number | Sense siRNA | AntiSense siRNA | Other Sp | Hum-34222182 ORF: 204-785 |
|---|---|---|---|---|
| 1307 | UUAUCUUUGACUCUCUUGCCUGU | ACAGGCAAGAGAGUCAAAGAUAA | | [2462-2484] 3'UTR |
| 1308 | UGUGGCUAUCACCCAGAGAGCCU | AGGCUCUCUGGGUGAUAGCCACA | Chimp | [264-286] ORF |
| 1309 | CUGUGGCUAUCACCCAGAGAGCC | GGCUCUCUGGGUGAUAGCCACAG | Chimp | [263-285] ORF |
| 1310 | ACUGUGGCUAUCACCCAGAGAGC | GCUCUCUGGGUGAUAGCCACAGU | Chimp | [262-284] ORF |
| 1311 | GACUGUGGCUAUCACCCAGAGAG | CUCUCUGGGUGAUAGCCACAGUC | Chimp | [261-283] ORF |
| 1312 | GGACUGUGGCUAUCACCCAGAGA | UCUCUGGGUGAUAGCCACAGUCC | Chimp | [260-282] ORF |
| 1313 | AUAAAGGCCUUAUUUUUGUCUU | AAGACAAAAAUAAGGCCUUUAU | | [1945-1967] 3'UTR |
| 1314 | CAGUGUUAUCUCAUCUCUGGGCU | AGCCCAGAGAUGAGAUAACACUG | | [1707-1729] 3'UTR |
| 1315 | UGCAACUGGCAGUUUGAGCAGCA | UGCUGCUCAAACUGCCAGUUGCA | Dog, Chimp | [209-231] ORF |
| 1316 | UUGCAACUGGCAGUUUGAGCAGC | GCUGCUCAAACUGCCAGUUGCAA | Dog, Chimp | [208-230] ORF |
| 1317 | GAUUAUUUCAUGAUUGGGUAGUA | UACUACCCAAUCAUGAAAUAAUC | | [804-826] 3'UTR |
| 1318 | AGAUGCCUUUAUAAGCUCAGUUU | AAACUGAGCUUAUAAAGGCAUCU | | [1461-1483] 3'UTR |
| 1319 | UAGAUGCCUUUAUAAGCUCAGUU | AACUGAGCUUAUAAAGGCAUCUA | | [1460-1482] 3'UTR |
| 1320 | UUAGAUGCCUUUAUAAGCUCAGU | ACUGAGCUUAUAAAGGCAUCUAA | | [1459-1481] 3'UTR |
| 1321 | UUUAGAUGCCUUUAUAAGCUCAG | CUGAGCUUAUAAAGGCAUCUAAA | | [1458-1480] 3'UTR |
| 1322 | UUUUAGAUGCCUUUAUAAGCUCA | UGAGCUUAUAAAGGCAUCUAAAA | | [1457-1479] 3'UTR |
| 1323 | GUUAAGCUCCAAAGGUUCACUGU | ACAGUGAACCUUUGGAGCUUAAC | | [2349-2371] 3'UTR |
| 1324 | UGUUAAGCUCCAAAGGUUCACUG | CAGUGAACCUUUGGAGCUUAACA | | [2348-2370] 3'UTR |
| 1325 | UUGUUAAGCUCCAAAGGUUCACU | AGUGAACCUUUGGAGCUUAACAA | | [2347-2369] 3'UTR |
| 1326 | AUUGUUAAGCUCCAAAGGUUCAC | GUGAACCUUUGGAGCUUAACAAU | | [2346-2368] 3'UTR |
| 1327 | UAUUGUUAAGCUCCAAAGGUUCA | UGAACCUUUGGAGCUUAACAAUA | | [2345-2367] 3'UTR |

SEQUENCE LISTING (6984 sequences)

SEQ ID NO: 1 - RNA, 2580 nt, HomoSapiens
agccggcgcaggguggccggggaggggugagcagggugccgcuggcugcuggggucugcaggucaccgaguccccaggagaggggacuccuaagaagccaccugccuguguuuacccggcagcgagcgcgcaggcccccgcgaacuccuggcagcgcucaggaaaggccguugcgccucgcgaaggaaacagagccguugaccaugguugcaacuggcaguuugagcagcaagaacccggccagcauuucagaauugcuggacuguggcuaucacccagagagccugcuaagugauuuugacuacugggauuauguuguuccugaacccaaccucaacgagguaauauuugaggaaucaacuugccagaauuugguuaaaaugcuggagaacugucuguccaaaucaaagcaaacuaaacuugguugcucaaagguccuugucccugagaaacugacccagagaauugcucaagauguccugcggcuuuccucaacggagcccugcggcuugcgagguuguguuaugcacgugaacuuggaaauugaaaauguauguaaaaagcuggauaggauugugugugauucuagcgucguaccuacuuuugagcuuacacuuguguuuaagcaggagaacugcucauggacuagcuucagggacuuuuucuuuaguagaggucgcuucuccucugguuucaggagaacucugauccucagcucaggauuucgacuuguuaagaaaaaacuuuacucacugauuggaacaacagugauugaaggguccuaaaaagggaaaauauauaaagauuauuucaugauuggguaguaaaacuauucagcuagucagcuaaagucauuuguaguuugccccaccugcccuaaauaagaaaccccaaauguagucucuuuucuuucuguguuucacauucauagcaacugcagcuaacaggcugauuuucuggccuuuggagaagugauucaaaauaguguagauuuucugcauagaucccauuuuuguacagaauugaaugggauggaauagguaagcaaaaguagaagcccauuugaguuuuacauuugauuccacaauuugguuucagguaggcuugguaauagacuauauaaaccagauuugccuauuuugauuuucauauggcuuuuuuuucucuaaguuuucagaggauuuuuuaaaucacagaaucauacuaaaugauauuuagccuaucaaaacuuccaaaagcccacaccaccaguuccugacucaaauuugaaggguuuuuagacaggaagguaggauuaaguaggugaguuuaauuaaagcuuaacccuagguaagaguaaaugagaaauauuacggcaauaauggaacugcuucacuguuucuuggugacuuccucacucuaauguuuuaaagaggcaacaaaagcuuguggugccauuucaguaaccacgguguuguuuuagaugccuuuauaagcucaguuuccccuguucuuaaguguugaauacugucuuuaaacuagaaaaaugcaaaauauugaacugauauuuuuguguguaguugauuacucuuccauugagugaaugaugaauaccugugaggauaggaaauuaguucugagaucuagucccucucugauucacuuaguaaucuauccucuuuucaguauuacaugugcuuaaucucagaugaaccauuucaccauggcaguguuaucucaucucugggcuuuucugggaauugaaguaucucuccuuaaccccaauugucaaggguaguagcuguauacuaccacuuugaauuauugaaacgggucaauuuacgaagucugcauuggcuauggagauaugguuuauaguacagccuagagaaugaaacucaccguccagauaaccaugcaugcacccagauuuuuuccaccuuggauaccugucacuagggaauaauaaaggccuuauuuuuugucuuauuccaacuaaguagaucauuaucucuuuccuuuuuuauguuaaugagagaauuuagccuccacucaacaauguucaauucagcaaggcuuucauauccuugcugugggucguggauaaggagcuuauucagguuuccugcccuagcuauuagcuccacuucacaugcuggagaccggcguagggacagauguauucauccugguguuacugaaaaacaggugugauccuguuacugauacuauaagugaccuaaaaugucacuguucaaauuagccaguguucuaacaaacuaaacucuucaaaugcuuggaaagauacuacaaagccaaucuuuauagaauugggccaagauaaaucaauguuguuuugcaugucuauuguuaagcuccaaagguucacuguguuucugccgcuguccuggaguugucaccacugacugggcaaggcuucuugggcaucgauguagaacuguuguccuuuuuccacuaacaguuaucuuugacucucuugccuguuaugcuuacaaaauggugauggcuuauggaaggcuguuaaauuaauauuccuguuaaaggaaauuaaaguuugucuauuuuugacaauaaaacauu

SEQ ID NO: 2 - RNA, 19 nt, artificial
  Chemically synthesized
gccaguguucuaacaaacu

SEQ ID NO: 3 - RNA, 19 nt, artificial
  Chemically synthesized
uagccaguguucuaacaaa

SEQ ID NO: 4 - RNA, 19 nt, artificial
  Chemically synthesized
gugacuuccucacucuaau

SEQ ID NO: 5 - RNA, 19 nt, artificial
  Chemically synthesized
agccaguguucuaacaaac

SEQ ID NO: 6 - RNA, 19 nt, artificial
  Chemically synthesized
gagugaaugaugaauaccu

SEQ ID NO: 7 - RNA, 19 nt, artificial
  Chemically synthesized
gacuuccucacucuaaugu

SEQ ID NO: 8 - RNA, 19 nt, artificial
  Chemically synthesized
guucuaacaaacuaaacuc

SEQ ID NO: 9 - RNA, 19 nt, artificial
  Chemically synthesized
gaaugaugaauaccuguga

SEQ ID NO: 10 - RNA, 19 nt, artificial
  Chemically synthesized
uccucacucuaauguuuua

SEQ ID NO: 11 - RNA, 19 nt, artificial
  Chemically synthesized
gccagaauuugguuaaaau

SEQ ID NO: 12 - RNA, 19 nt, artificial
  Chemically synthesized
acgggucaauuuacgaagu

SEQ ID NO: 13 - RNA, 19 nt, artificial
  Chemically synthesized
uccauugagugaaugauga

SEQ ID NO: 14 - RNA, 19 nt, artificial
  Chemically synthesized
uuccucacucuaauguuuu

SEQ ID NO: 15 - RNA, 19 nt, artificial
  Chemically synthesized
gcacccagauuuuuuccac

SEQ ID NO: 16 - RNA, 19 nt, artificial
  Chemically synthesized
guggugccauuucaguaac

SEQ ID NO: 17 - RNA, 19 nt, artificial
  Chemically synthesized
ccucacucuaauguuuuaa

SEQ ID NO: 18 - RNA, 19 nt, artificial
  Chemically synthesized
cuuccucacucuaauguuu

SEQ ID NO: 19 - RNA, 19 nt, artificial
  Chemically synthesized
ggcuuuuuuuucucuaagu

SEQ ID NO: 20 - RNA, 19 nt, artificial
  Chemically synthesized
ucccauuuuuguacagaau

SEQ ID NO: 21 - RNA, 19 nt, artificial
  Chemically synthesized
gagaagugauucaaaauag

SEQ ID NO: 22 - RNA, 19 nt, artificial
  Chemically synthesized
ggagaagugauucaaaaua

SEQ ID NO: 23 - RNA, 19 nt, artificial
  Chemically synthesized
gucagcuaaagucauuugu

SEQ ID NO: 24 - RNA, 19 nt, artificial
  Chemically synthesized
ccggccagcauuucagaau

SEQ ID NO: 25 - RNA, 19 nt, artificial
  Chemically synthesized
augcuggagaacugucugu

SEQ ID NO: 26 - RNA, 19 nt, artificial
  Chemically synthesized
aaaugcuggagaacugucu

SEQ ID NO: 27 - RNA, 19 nt, artificial
  Chemically synthesized
ugguuaaaaugcuggagaa

SEQ ID NO: 28 - RNA, 19 nt, artificial
  Chemically synthesized
uugguuaaaaugcuggaga

SEQ ID NO: 29 - RNA, 19 nt, artificial
  Chemically synthesized
uagcuccacuucacaugcu

SEQ ID NO: 30 - RNA, 19 nt, artificial
  Chemically synthesized
agccuccacucaacaaugu

SEQ ID NO: 31 - RNA, 19 nt, artificial
  Chemically synthesized
acccagauuuuuuccaccu

SEQ ID NO: 32 - RNA, 19 nt, artificial
  Chemically synthesized
ugcacccagauuuuuucca

SEQ ID NO: 33 - RNA, 19 nt, artificial
  Chemically synthesized
aaacgggucaauuuacgaa

SEQ ID NO: 34 - RNA, 19 nt, artificial
  Chemically synthesized
augaugaauaccugugagg

SEQ ID NO: 35 - RNA, 19 nt, artificial
  Chemically synthesized
uugagugaaugaugaauac

SEQ ID NO: 36 - RNA, 19 nt, artificial
  Chemically synthesized
cggcaauaauggaacugcu

SEQ ID NO: 37 - RNA, 19 nt, artificial
  Chemically synthesized
gccuaucaaaacuuccaaa

SEQ ID NO: 38 - RNA, 19 nt, artificial
  Chemically synthesized
uggcuuuuuuuucucuaag

SEQ ID NO: 39 - RNA, 19 nt, artificial
  Chemically synthesized
gcccauuugaguuuuacau

SEQ ID NO: 40 - RNA, 19 nt, artificial
  Chemically synthesized
ggccagcauuucagaauug

SEQ ID NO: 41 - RNA, 19 nt, artificial
  Chemically synthesized
cggccagcauuucagaauu

SEQ ID NO: 42 - RNA, 19 nt, artificial
  Chemically synthesized
gcgucguaccuacuuuuga

SEQ ID NO: 43 - RNA, 19 nt, artificial
  Chemically synthesized
uagcgucguaccuacuuuu

SEQ ID NO: 44 - RNA, 19 nt, artificial
  Chemically synthesized
augcacgugaacuuggaaa

SEQ ID NO: 45 - RNA, 19 nt, artificial
  Chemically synthesized
uuguccuuuuuccacuaac

SEQ ID NO: 46 - RNA, 19 nt, artificial
  Chemically synthesized
guuguccuuuuuccacuaa

SEQ ID NO: 47 - RNA, 19 nt, artificial
  Chemically synthesized
cuguuguccuuuuuccacu

SEQ ID NO: 48 - RNA, 19 nt, artificial
  Chemically synthesized
cuggagaacugucugucca

SEQ ID NO: 49 - RNA, 19 nt, artificial
  Chemically synthesized
gccaaucuuuauagaauug

SEQ ID NO: 50 - RNA, 19 nt, artificial
  Chemically synthesized
guucaaauuagccaguguu

SEQ ID NO: 51 - RNA, 19 nt, artificial
  Chemically synthesized
ugccagaauuugguuaaaa

SEQ ID NO: 52 - RNA, 19 nt, artificial
  Chemically synthesized
cccagauuuuuuccaccuu

SEQ ID NO: 53 - RNA, 19 nt, artificial
  Chemically synthesized
cacccagauuuuuuccacc

SEQ ID NO: 54 - RNA, 19 nt, artificial
  Chemically synthesized
caauuuacgaagucugcau

SEQ ID NO: 55 - RNA, 19 nt, artificial
  Chemically synthesized
gggucaauuuacgaagucu

SEQ ID NO: 56 - RNA, 19 nt, artificial
  Chemically synthesized
aacgggucaauuuacgaag

SEQ ID NO: 57 - RNA, 19 nt, artificial
  Chemically synthesized
ugaaacgggucaauuuacg

SEQ ID NO: 58 - RNA, 19 nt, artificial
  Chemically synthesized
uggugccauuucaguaacc

SEQ ID NO: 59 - RNA, 19 nt, artificial
  Chemically synthesized
uggaacugcuucacuguuu

SEQ ID NO: 60 - RNA, 19 nt, artificial
  Chemically synthesized
aagguaggauuaaguaggu

SEQ ID NO: 61 - RNA, 19 nt, artificial
  Chemically synthesized
caggaagguaggauuaagu

SEQ ID NO: 62 - RNA, 19 nt, artificial
  Chemically synthesized
agccuaucaaaacuuccaa

SEQ ID NO: 63 - RNA, 19 nt, artificial
  Chemically synthesized
aaccagauuugccuauuuu

SEQ ID NO: 64 - RNA, 19 nt, artificial
  Chemically synthesized
guacagaauugaaugggau

SEQ ID NO: 65 - RNA, 19 nt, artificial
  Chemically synthesized
aucccauuuuuguacagaa

SEQ ID NO: 66 - RNA, 19 nt, artificial
  Chemically synthesized
cagcuaaagucauuuguag

SEQ ID NO: 67 - RNA, 19 nt, artificial
  Chemically synthesized
augauuggguaguaaaacu

SEQ ID NO: 68 - RNA, 19 nt, artificial
  Chemically synthesized
aggguccuaaaaagggaaa

SEQ ID NO: 69 - RNA, 19 nt, artificial
  Chemically synthesized
acgugaacuuggaaauuga

SEQ ID NO: 70 - RNA, 19 nt, artificial
  Chemically synthesized
gaauugcucaagauguccu

SEQ ID NO: 71 - RNA, 19 nt, artificial
  Chemically synthesized
gagaauugcucaagauguc

SEQ ID NO: 72 - RNA, 19 nt, artificial
  Chemically synthesized
agagaauugcucaagaugu

SEQ ID NO: 73 - RNA, 19 nt, artificial
  Chemically synthesized
ccagagaauugcucaagau

SEQ ID NO: 74 - RNA, 19 nt, artificial
  Chemically synthesized
cccagagaauugcucaaga

SEQ ID NO: 75 - RNA, 19 nt, artificial
  Chemically synthesized
aacugucuguccaaaucaa

SEQ ID NO: 76 - RNA, 19 nt, artificial
  Chemically synthesized
uguccuuuuuccacuaaca

SEQ ID NO: 77 - RNA, 19 nt, artificial
  Chemically synthesized
gaacuguuguccuuuuucc

SEQ ID NO: 78 - RNA, 19 nt, artificial
  Chemically synthesized
ggagaacugucuguccaaa

SEQ ID NO: 79 - RNA, 19 nt, artificial
  Chemically synthesized
caguguucuaacaaacuaa

SEQ ID NO: 80 - RNA, 19 nt, artificial
  Chemically synthesized
aaauuagccaguguucuaa

SEQ ID NO: 81 - RNA, 19 nt, artificial
  Chemically synthesized
gaccuaaaaugucacuguu

SEQ ID NO: 82 - RNA, 19 nt, artificial
  Chemically synthesized
uugccagaauuugguuaaa

SEQ ID NO: 83 - RNA, 19 nt, artificial
  Chemically synthesized
uggauaaggagcuuauuca

SEQ ID NO: 84 - RNA, 19 nt, artificial
  Chemically synthesized
agcaaggcuuucauauccu

SEQ ID NO: 85 - RNA, 19 nt, artificial
  Chemically synthesized
cuccacucaacaauguuca

SEQ ID NO: 86 - RNA, 19 nt, artificial
  Chemically synthesized
uuagccuccacucaacaau

SEQ ID NO: 87 - RNA, 19 nt, artificial
  Chemically synthesized
agagaauuuagccuccacu

SEQ ID NO: 88 - RNA, 19 nt, artificial
  Chemically synthesized
agaucauuaucucuuuccu

SEQ ID NO: 89 - RNA, 19 nt, artificial
  Chemically synthesized
ggccuuauuuuuugucuua

SEQ ID NO: 90 - RNA, 19 nt, artificial
  Chemically synthesized
cagauuuuuuccaccuugg

SEQ ID NO: 91 - RNA, 19 nt, artificial
  Chemically synthesized
ccagauuuuuuccaccuug

SEQ ID NO: 92 - RNA, 19 nt, artificial
  Chemically synthesized
gccuagagaaugaaacuca

SEQ ID NO: 93 - RNA, 19 nt, artificial
  Chemically synthesized
uacgaagucugcauuggcu

SEQ ID NO: 94 - RNA, 19 nt, artificial
  Chemically synthesized
cgggucaauuuacgaaguc

SEQ ID NO: 95 - RNA, 19 nt, artificial
  Chemically synthesized
gaaacgggucaauuuacga

SEQ ID NO: 96 - RNA, 19 nt, artificial
  Chemically synthesized
gucccucucugauucacuu

SEQ ID NO: 97 - RNA, 19 nt, artificial
  Chemically synthesized
gagaggggacuccuaagaa

SEQ ID NO: 98 - RNA, 19 nt, artificial
  Chemically synthesized
gaagguaggauuaaguagg

SEQ ID NO: 99 - RNA, 19 nt, artificial
  Chemically synthesized
uagccuaucaaaacuucca

SEQ ID NO: 100 - RNA, 19 nt, artificial
  Chemically synthesized
ccauuuuuguacagaauug

SEQ ID NO: 101 - RNA, 19 nt, artificial
  Chemically synthesized
uagaucccauuuuuguaca

SEQ ID NO: 102 - RNA, 19 nt, artificial
  Chemically synthesized
gcagcuaacaggcugauuu

SEQ ID NO: 103 - RNA, 19 nt, artificial
  Chemically synthesized
guguuucacauucauagca

SEQ ID NO: 104 - RNA, 19 nt, artificial
  Chemically synthesized
guccuaaaaagggaaaaua

SEQ ID NO: 105 - RNA, 19 nt, artificial
  Chemically synthesized
ggguccuaaaaagggaaaa

SEQ ID NO: 106 - RNA, 19 nt, artificial
  Chemically synthesized
aaggguccuaaaaagggaa

SEQ ID NO: 107 - RNA, 19 nt, artificial
  Chemically synthesized
cagggacuuuuucuuuagu

SEQ ID NO: 108 - RNA, 19 nt, artificial
  Chemically synthesized
ugcacgugaacuuggaaau

SEQ ID NO: 109 - RNA, 19 nt, artificial
  Chemically synthesized
guguuaugcacgugaacuu

SEQ ID NO: 110 - RNA, 19 nt, artificial
  Chemically synthesized
guuguguuaugcacgugaa

SEQ ID NO: 111 - RNA, 19 nt, artificial
  Chemically synthesized
gagguuguguuaugcacgu

SEQ ID NO: 112 - RNA, 19 nt, artificial
  Chemically synthesized
gacccagagaauugcucaa

SEQ ID NO: 113 - RNA, 19 nt, artificial
  Chemically synthesized
aagcaaacuaaacuugguu

SEQ ID NO: 114 - RNA, 19 nt, artificial
  Chemically synthesized
ccaaaucaaagcaaacuaa

SEQ ID NO: 115 - RNA, 19 nt, artificial
  Chemically synthesized
ggaaggcuguuaaauuaau

SEQ ID NO: 116 - RNA, 19 nt, artificial
  Chemically synthesized
ugccuguuaugcuuacaaa

SEQ ID NO: 117 - RNA, 19 nt, artificial
  Chemically synthesized
uugccuguuaugcuuacaa

SEQ ID NO: 118 - RNA, 19 nt, artificial
  Chemically synthesized
ugacucucuugccuguuau

SEQ ID NO: 119 - RNA, 19 nt, artificial
  Chemically synthesized
guccuuuuuccacuaacag

SEQ ID NO: 120 - RNA, 19 nt, artificial
  Chemically synthesized
uagaacuguuguccuuuuu

SEQ ID NO: 121 - RNA, 19 nt, artificial
  Chemically synthesized
guagaacuguuguccuuuu

SEQ ID NO: 122 - RNA, 19 nt, artificial
  Chemically synthesized
gagaacugucuguccaaau

SEQ ID NO: 123 - RNA, 19 nt, artificial
  Chemically synthesized
gccaagauaaaucaauguu

SEQ ID NO: 124 - RNA, 19 nt, artificial
  Chemically synthesized
acaaagccaaucuuuauag

SEQ ID NO: 125 - RNA, 19 nt, artificial
  Chemically synthesized
augucacuguucaaauuag

SEQ ID NO: 126 - RNA, 19 nt, artificial
  Chemically synthesized
gugauccuguuacugauac

SEQ ID NO: 127 - RNA, 19 nt, artificial
  Chemically synthesized
gaauuugguuaaaaugcug

SEQ ID NO: 128 - RNA, 19 nt, artificial
  Chemically synthesized
aggcuuucauauccuugcu

SEQ ID NO: 129 - RNA, 19 nt, artificial
  Chemically synthesized
cagcaaggcuuucauaucc

SEQ ID NO: 130 - RNA, 19 nt, artificial
  Chemically synthesized
gccuccacucaacaauguu

SEQ ID NO: 131 - RNA, 19 nt, artificial
  Chemically synthesized
gaauuuagccuccacucaa

SEQ ID NO: 132 - RNA, 19 nt, artificial
  Chemically synthesized
gagagaauuuagccuccac

SEQ ID NO: 133 - RNA, 19 nt, artificial
  Chemically synthesized
uagaucauuaucucuuucc

SEQ ID NO: 134 - RNA, 19 nt, artificial
  Chemically synthesized
aggccuuauuuuuugucuu

SEQ ID NO: 135 - RNA, 19 nt, artificial
  Chemically synthesized
aaggccuuauuuuuugucu

SEQ ID NO: 136 - RNA, 19 nt, artificial
  Chemically synthesized
gcaugcacccagauuuuuu

SEQ ID NO: 137 - RNA, 19 nt, artificial
  Chemically synthesized
ggucaauuuacgaagucug

SEQ ID NO: 138 - RNA, 19 nt, artificial
  Chemically synthesized
gggcuuuucugggaauuga

SEQ ID NO: 139 - RNA, 19 nt, artificial
  Chemically synthesized
auaccugugaggauaggaa

SEQ ID NO: 140 - RNA, 19 nt, artificial
  Chemically synthesized
acucuuccauugagugaau

SEQ ID NO: 141 - RNA, 19 nt, artificial
  Chemically synthesized
gggauuauguuguuccuga

SEQ ID NO: 142 - RNA, 19 nt, artificial
  Chemically synthesized
ugccauuucaguaaccacg

SEQ ID NO: 143 - RNA, 19 nt, artificial
  Chemically synthesized
uguggugccauuucaguaa

SEQ ID NO: 144 - RNA, 19 nt, artificial
  Chemically synthesized
agcuuguggugccauuuca

SEQ ID NO: 145 - RNA, 19 nt, artificial
  Chemically synthesized
cucuaauguuuuaaagagg

SEQ ID NO: 146 - RNA, 19 nt, artificial
  Chemically synthesized
gaacugcuucacuguuucu

SEQ ID NO: 147 - RNA, 19 nt, artificial
  Chemically synthesized
ggaacugcuucacuguuuc

SEQ ID NO: 148 - RNA, 19 nt, artificial
  Chemically synthesized
acggcaauaauggaacugc

SEQ ID NO: 149 - RNA, 19 nt, artificial
  Chemically synthesized
acccuagguaagaguaaau

SEQ ID NO: 150 - RNA, 19 nt, artificial
  Chemically synthesized
cucuaaguuuucagaggau

SEQ ID NO: 151 - RNA, 19 nt, artificial
  Chemically synthesized
gcuugguaauagacuauau

SEQ ID NO: 152 - RNA, 19 nt, artificial
  Chemically synthesized
aggcuugguaauagacuau

SEQ ID NO: 153 - RNA, 19 nt, artificial
  Chemically synthesized
gaguuuuacauuugauucc

SEQ ID NO: 154 - RNA, 19 nt, artificial
  Chemically synthesized
gaagcccauuugaguuuua

SEQ ID NO: 155 - RNA, 19 nt, artificial
  Chemically synthesized
gagccugcuaagugauuuu

SEQ ID NO: 156 - RNA, 19 nt, artificial
  Chemically synthesized
uguacagaauugaauggga

SEQ ID NO: 157 - RNA, 19 nt, artificial
  Chemically synthesized
uuguacagaauugaauggg

SEQ ID NO: 158 - RNA, 19 nt, artificial
  Chemically synthesized
gugauucaaaauaguguag

SEQ ID NO: 159 - RNA, 19 nt, artificial
  Chemically synthesized
uuggagaagugauucaaaa

SEQ ID NO: 160 - RNA, 19 nt, artificial
  Chemically synthesized
caggcugauuuucuggccu

SEQ ID NO: 161 - RNA, 19 nt, artificial
  Chemically synthesized
gcuaacaggcugauuuucu

SEQ ID NO: 162 - RNA, 19 nt, artificial
  Chemically synthesized
gcuaaagucauuuguaguu

SEQ ID NO: 163 - RNA, 19 nt, artificial
  Chemically synthesized
uagucagcuaaagucauuu

SEQ ID NO: 164 - RNA, 19 nt, artificial
  Chemically synthesized
cuagucagcuaaagucauu

SEQ ID NO: 165 - RNA, 19 nt, artificial
  Chemically synthesized
ugauuggguaguaaaacua

SEQ ID NO: 166 - RNA, 19 nt, artificial
  Chemically synthesized
gcauuucagaauugcugga

SEQ ID NO: 167 - RNA, 19 nt, artificial
  Chemically synthesized
gaaggguccuaaaaaggga

SEQ ID NO: 168 - RNA, 19 nt, artificial
  Chemically synthesized
gguuucaggagaacucuga

SEQ ID NO: 169 - RNA, 19 nt, artificial
  Chemically synthesized
uccucugguuucaggagaa

SEQ ID NO: 170 - RNA, 19 nt, artificial
  Chemically synthesized
agggacuuuuucuuuagua

SEQ ID NO: 171 - RNA, 19 nt, artificial
  Chemically synthesized
cuacuuuugagcuuacacu

SEQ ID NO: 172 - RNA, 19 nt, artificial
  Chemically synthesized
cuagcgucguaccuacuuu

SEQ ID NO: 173 - RNA, 19 nt, artificial
  Chemically synthesized
guaaaaagcuggauaggau

SEQ ID NO: 174 - RNA, 19 nt, artificial
  Chemically synthesized
uuaugcacgugaacuugga

SEQ ID NO: 175 - RNA, 19 nt, artificial
  Chemically synthesized
gguuguguuaugcacguga

SEQ ID NO: 176 - RNA, 19 nt, artificial
  Chemically synthesized
gcgagguuguguuaugcac

SEQ ID NO: 177 - RNA, 19 nt, artificial
  Chemically synthesized
aaagcaaacuaaacuuggu

SEQ ID NO: 178 - RNA, 19 nt, artificial
  Chemically synthesized
cuguuaugcuuacaaaaug

SEQ ID NO: 179 - RNA, 19 nt, artificial
  Chemically synthesized
uccuuuuuccacuaacagu

SEQ ID NO: 180 - RNA, 19 nt, artificial
  Chemically synthesized
caaucuuuauagaauuggg

SEQ ID NO: 181 - RNA, 19 nt, artificial
  Chemically synthesized
ccaaucuuuauagaauugg

SEQ ID NO: 182 - RNA, 19 nt, artificial
  Chemically synthesized
auacuacaaagccaaucuu

SEQ ID NO: 183 - RNA, 19 nt, artificial
  Chemically synthesized
ccaguguucuaacaaacua

SEQ ID NO: 184 - RNA, 19 nt, artificial
  Chemically synthesized
acuguucaaauuagccagu

SEQ ID NO: 185 - RNA, 19 nt, artificial
  Chemically synthesized
ccuaaaaugucacuguuca

SEQ ID NO: 186 - RNA, 19 nt, artificial
  Chemically synthesized
ugaccuaaaaugucacugu

SEQ ID NO: 187 - RNA, 19 nt, artificial
  Chemically synthesized
uaagugaccuaaaauguca

SEQ ID NO: 188 - RNA, 19 nt, artificial
  Chemically synthesized
cuauaagugaccuaaaaug

SEQ ID NO: 189 - RNA, 19 nt, artificial
  Chemically synthesized
gugugauccuguuacugau

SEQ ID NO: 190 - RNA, 19 nt, artificial
  Chemically synthesized
ccacuucacaugcuggaga

SEQ ID NO: 191 - RNA, 19 nt, artificial
  Chemically synthesized
ggcuuucauauccuugcug

SEQ ID NO: 192 - RNA, 19 nt, artificial
  Chemically synthesized
gcaaggcuuucauauccuu

SEQ ID NO: 193 - RNA, 19 nt, artificial
  Chemically synthesized
cacucaacaauguucaauu

SEQ ID NO: 194 - RNA, 19 nt, artificial
  Chemically synthesized
uagccuccacucaacaaug

SEQ ID NO: 195 - RNA, 19 nt, artificial
  Chemically synthesized
guagaucauuaucucuuuc

SEQ ID NO: 196 - RNA, 19 nt, artificial
  Chemically synthesized
ccaccuuggauaccuguca

SEQ ID NO: 197 - RNA, 19 nt, artificial
  Chemically synthesized
augcaugcacccagauuuu

SEQ ID NO: 198 - RNA, 19 nt, artificial
  Chemically synthesized
uugaaacgggucaauuuac

SEQ ID NO: 199 - RNA, 19 nt, artificial
  Chemically synthesized
ucaacgagguaauauuuga

SEQ ID NO: 200 - RNA, 19 nt, artificial
  Chemically synthesized
accucaacgagguaauauu

SEQ ID NO: 201 - RNA, 19 nt, artificial
  Chemically synthesized
ccaaccucaacgagguaau

SEQ ID NO: 202 - RNA, 19 nt, artificial
  Chemically synthesized
gugcuuaaucucagaugaa

SEQ ID NO: 203 - RNA, 19 nt, artificial
  Chemically synthesized
cuagucccucucugauuca

SEQ ID NO: 204 - RNA, 19 nt, artificial
  Chemically synthesized
augaauaccugugaggaua

SEQ ID NO: 205 - RNA, 19 nt, artificial
  Chemically synthesized
agaggggacuccuaagaag

SEQ ID NO: 206 - RNA, 19 nt, artificial
  Chemically synthesized
gauuacucuuccauugagu

SEQ ID NO: 207 - RNA, 19 nt, artificial
  Chemically synthesized
ugauuacucuuccauugag

SEQ ID NO: 208 - RNA, 19 nt, artificial
  Chemically synthesized
uaguugauuacucuuccau

SEQ ID NO: 209 - RNA, 19 nt, artificial
  Chemically synthesized
guaguugauuacucuucca

SEQ ID NO: 210 - RNA, 19 nt, artificial
  Chemically synthesized
guguugaauacugucuuua

SEQ ID NO: 211 - RNA, 19 nt, artificial
  Chemically synthesized
aagcucaguuuccccuguu

SEQ ID NO: 212 - RNA, 19 nt, artificial
  Chemically synthesized
accacgguguuguuuuaga

SEQ ID NO: 213 - RNA, 19 nt, artificial
  Chemically synthesized
gugccauuucaguaaccac

SEQ ID NO: 214 - RNA, 19 nt, artificial
  Chemically synthesized
ggugccauuucaguaacca

SEQ ID NO: 215 - RNA, 19 nt, artificial
  Chemically synthesized
cugcuucacuguuucuugg

SEQ ID NO: 216 - RNA, 19 nt, artificial
  Chemically synthesized
aacugcuucacuguuucuu

SEQ ID NO: 217 - RNA, 19 nt, artificial
  Chemically synthesized
caauaauggaacugcuuca

SEQ ID NO: 218 - RNA, 19 nt, artificial
  Chemically synthesized
agguaagaguaaaugagaa

SEQ ID NO: 219 - RNA, 19 nt, artificial
  Chemically synthesized
ggauuaaguaggugaguuu

SEQ ID NO: 220 - RNA, 19 nt, artificial
  Chemically synthesized
gacucaaauuugaaggguu

SEQ ID NO: 221 - RNA, 19 nt, artificial
  Chemically synthesized
cagauuugccuauuuugau

SEQ ID NO: 222 - RNA, 19 nt, artificial
  Chemically synthesized
ccagauuugccuauuuuga

SEQ ID NO: 223 - RNA, 19 nt, artificial
  Chemically synthesized
auauaaaccagauuugccu

SEQ ID NO: 224 - RNA, 19 nt, artificial
  Chemically synthesized
ggcuugguaauagacuaua

SEQ ID NO: 225 - RNA, 19 nt, artificial
  Chemically synthesized
uuccacaauuugguuucag

SEQ ID NO: 226 - RNA, 19 nt, artificial
  Chemically synthesized
uuugauuccacaauuuggu

SEQ ID NO: 227 - RNA, 19 nt, artificial
  Chemically synthesized
ggaauagguaagcaaaagu

SEQ ID NO: 228 - RNA, 19 nt, artificial
  Chemically synthesized
cagaauugaaugggaugga

SEQ ID NO: 229 - RNA, 19 nt, artificial
  Chemically synthesized
gaucccauuuuuguacaga

SEQ ID NO: 230 - RNA, 19 nt, artificial
  Chemically synthesized
agaucccauuuuuguacag

SEQ ID NO: 231 - RNA, 19 nt, artificial
  Chemically synthesized
guguagauuuucugcauag

SEQ ID NO: 232 - RNA, 19 nt, artificial
  Chemically synthesized
aggcugauuuucuggccuu

SEQ ID NO: 233 - RNA, 19 nt, artificial
  Chemically synthesized
cacauucauagcaacugca

SEQ ID NO: 234 - RNA, 19 nt, artificial
  Chemically synthesized
ccccaccugcccuaaauaa

SEQ ID NO: 235 - RNA, 19 nt, artificial
  Chemically synthesized
agcuaaagucauuuguagu

SEQ ID NO: 236 - RNA, 19 nt, artificial
  Chemically synthesized
ucagcuaaagucauuugua

SEQ ID NO: 237 - RNA, 19 nt, artificial
  Chemically synthesized
cagcuagucagcuaaaguc

SEQ ID NO: 238 - RNA, 19 nt, artificial
  Chemically synthesized
uggguaguaaaacuauuca

SEQ ID NO: 239 - RNA, 19 nt, artificial
  Chemically synthesized
gauuauuucaugauugggu

SEQ ID NO: 240 - RNA, 19 nt, artificial
  Chemically synthesized
gguccuaaaaagggaaaau

SEQ ID NO: 241 - RNA, 19 nt, artificial
  Chemically synthesized
cagcauuucagaauugcug

SEQ ID NO: 242 - RNA, 19 nt, artificial
  Chemically synthesized
gccagcauuucagaauugc

SEQ ID NO: 243 - RNA, 19 nt, artificial
  Chemically synthesized
agaacucugauccucagcu

SEQ ID NO: 244 - RNA, 19 nt, artificial
  Chemically synthesized
uaagaagccaccugccugu

SEQ ID NO: 245 - RNA, 19 nt, artificial
  Chemically synthesized
cuccucugguuucaggaga

SEQ ID NO: 246 - RNA, 19 nt, artificial
  Chemically synthesized
gggacuuuuucuuuaguag

SEQ ID NO: 247 - RNA, 19 nt, artificial
  Chemically synthesized
agcuuacacuuguguuuaa

SEQ ID NO: 248 - RNA, 19 nt, artificial
  Chemically synthesized
gucguaccuacuuuugagc

SEQ ID NO: 249 - RNA, 19 nt, artificial
  Chemically synthesized
agcgucguaccuacuuuug

SEQ ID NO: 250 - RNA, 19 nt, artificial
  Chemically synthesized
aagcuggauaggauugugu

SEQ ID NO: 251 - RNA, 19 nt, artificial
  Chemically synthesized
uugcgagguuguguuaugc

SEQ ID NO: 252 - RNA, 19 nt, artificial
  Chemically synthesized
uugcucaagauguccugcg

SEQ ID NO: 253 - RNA, 19 nt, artificial
  Chemically synthesized
acccagagaauugcucaag

SEQ ID NO: 254 - RNA, 19 nt, artificial
  Chemically synthesized
ucaaagcaaacuaaacuug

SEQ ID NO: 255 - RNA, 19 nt, artificial
  Chemically synthesized
uccaaaucaaagcaaacua

SEQ ID NO: 256 - RNA, 19 nt, artificial
  Chemically synthesized
auggaaggcuguuaaauua

SEQ ID NO: 257 - RNA, 19 nt, artificial
  Chemically synthesized
cuguccaaaucaaagcaaa

SEQ ID NO: 258 - RNA, 19 nt, artificial
  Chemically synthesized
gucuguccaaaucaaagca

SEQ ID NO: 259 - RNA, 19 nt, artificial
  Chemically synthesized
guuaugcuuacaaaauggu

SEQ ID NO: 260 - RNA, 19 nt, artificial
  Chemically synthesized
uugacucucuugccuguua

SEQ ID NO: 261 - RNA, 19 nt, artificial
  Chemically synthesized
ccuuuuuccacuaacaguu

SEQ ID NO: 262 - RNA, 19 nt, artificial
  Chemically synthesized
gaacugucuguccaaauca

SEQ ID NO: 263 - RNA, 19 nt, artificial
  Chemically synthesized
ugggcaucgauguagaacu

SEQ ID NO: 264 - RNA, 19 nt, artificial
  Chemically synthesized
aaagguucacuguguuucu

SEQ ID NO: 265 - RNA, 19 nt, artificial
  Chemically synthesized
uccaaagguucacuguguu

SEQ ID NO: 266 - RNA, 19 nt, artificial
  Chemically synthesized
gcaugucuauuguuaagcu

SEQ ID NO: 267 - RNA, 19 nt, artificial
  Chemically synthesized
ucaauguuguuuugcaugu

SEQ ID NO: 268 - RNA, 19 nt, artificial
  Chemically synthesized
uugggccaagauaaaucaa

SEQ ID NO: 269 - RNA, 19 nt, artificial
  Chemically synthesized
auugggccaagauaaauca

SEQ ID NO: 270 - RNA, 19 nt, artificial
  Chemically synthesized
caaagccaaucuuuauaga

SEQ ID NO: 271 - RNA, 19 nt, artificial
  Chemically synthesized
cuacaaagccaaucuuuau

SEQ ID NO: 272 - RNA, 19 nt, artificial
  Chemically synthesized
acuaaacucuucaaaugcu

SEQ ID NO: 273 - RNA, 19 nt, artificial
  Chemically synthesized
guguucuaacaaacuaaac

SEQ ID NO: 274 - RNA, 19 nt, artificial
  Chemically synthesized
ucacuguucaaauuagcca

SEQ ID NO: 275 - RNA, 19 nt, artificial
  Chemically synthesized
cuguuacugauacuauaag

SEQ ID NO: 276 - RNA, 19 nt, artificial
  Chemically synthesized
uccuguuacugauacuaua

SEQ ID NO: 277 - RNA, 19 nt, artificial
  Chemically synthesized
auccuguuacugauacuau

SEQ ID NO: 278 - RNA, 19 nt, artificial
  Chemically synthesized
caggugugauccuguuacu

SEQ ID NO: 279 - RNA, 19 nt, artificial
  Chemically synthesized
uagggacagauguauucau

SEQ ID NO: 280 - RNA, 19 nt, artificial
  Chemically synthesized
gcuauuagcuccacuucac

SEQ ID NO: 281 - RNA, 19 nt, artificial
  Chemically synthesized
gcccuagcuauuagcucca

SEQ ID NO: 282 - RNA, 19 nt, artificial
  Chemically synthesized
ucguggauaaggagcuuau

SEQ ID NO: 283 - RNA, 19 nt, artificial
  Chemically synthesized
aaggcuuucauauccuugc

SEQ ID NO: 284 - RNA, 19 nt, artificial
  Chemically synthesized
ccacucaacaauguucaau

SEQ ID NO: 285 - RNA, 19 nt, artificial
  Chemically synthesized
ccuccacucaacaauguuc

SEQ ID NO: 286 - RNA, 19 nt, artificial
  Chemically synthesized
ggauaccugucacuaggga

SEQ ID NO: 287 - RNA, 19 nt, artificial
  Chemically synthesized
accuuggauaccugucacu

SEQ ID NO: 288 - RNA, 19 nt, artificial
  Chemically synthesized
ucaccguccagauaaccau

SEQ ID NO: 289 - RNA, 19 nt, artificial
  Chemically synthesized
aacucaccguccagauaac

SEQ ID NO: 290 - RNA, 19 nt, artificial
  Chemically synthesized
gagauaugguuuauaguac

SEQ ID NO: 291 - RNA, 19 nt, artificial
  Chemically synthesized
gcauuggcuauggagauau

SEQ ID NO: 292 - RNA, 19 nt, artificial
  Chemically synthesized
aacgagguaauauuugagg

SEQ ID NO: 293 - RNA, 19 nt, artificial
  Chemically synthesized
caacgagguaauauuugag

SEQ ID NO: 294 - RNA, 19 nt, artificial
  Chemically synthesized
cuguauacuaccacuuuga

SEQ ID NO: 295 - RNA, 19 nt, artificial
  Chemically synthesized
uagcuguauacuaccacuu

SEQ ID NO: 296 - RNA, 19 nt, artificial
  Chemically synthesized
guagcuguauacuaccacu

SEQ ID NO: 297 - RNA, 19 nt, artificial
  Chemically synthesized
uggcaguguuaucucaucu

SEQ ID NO: 298 - RNA, 19 nt, artificial
  Chemically synthesized
ucucagaugaaccauuuca

SEQ ID NO: 299 - RNA, 19 nt, artificial
  Chemically synthesized
uaaucucagaugaaccauu

SEQ ID NO: 300 - RNA, 19 nt, artificial
  Chemically synthesized
cccucucugauucacuuag

SEQ ID NO: 301 - RNA, 19 nt, artificial
  Chemically synthesized
agucccucucugauucacu

SEQ ID NO: 302 - RNA, 19 nt, artificial
  Chemically synthesized
uagucccucucugauucac

SEQ ID NO: 303 - RNA, 19 nt, artificial
  Chemically synthesized
uugauuacucuuccauuga

SEQ ID NO: 304 - RNA, 19 nt, artificial
  Chemically synthesized
guguaguugauuacucuuc

SEQ ID NO: 305 - RNA, 19 nt, artificial
  Chemically synthesized
ccccuguucuuaaguguug

SEQ ID NO: 306 - RNA, 19 nt, artificial
  Chemically synthesized
uuccccuguucuuaagugu

SEQ ID NO: 307 - RNA, 19 nt, artificial
  Chemically synthesized
caguuuccccuguucuuaa

SEQ ID NO: 308 - RNA, 19 nt, artificial
  Chemically synthesized
gccuuuauaagcucaguuu

SEQ ID NO: 309 - RNA, 19 nt, artificial
  Chemically synthesized
guguuguuuuagaugccuu

SEQ ID NO: 310 - RNA, 19 nt, artificial
  Chemically synthesized
acgguguuguuuuagaugc

SEQ ID NO: 311 - RNA, 19 nt, artificial
  Chemically synthesized
ccacgguguuguuuuagau

SEQ ID NO: 312 - RNA, 19 nt, artificial
  Chemically synthesized
ucaguaaccacgguguugu

SEQ ID NO: 313 - RNA, 19 nt, artificial
  Chemically synthesized
ccauuucaguaaccacggu

SEQ ID NO: 314 - RNA, 19 nt, artificial
  Chemically synthesized
guaggauuaaguaggugag

SEQ ID NO: 315 - RNA, 19 nt, artificial
  Chemically synthesized
gguaggauuaaguagguga

SEQ ID NO: 316 - RNA, 19 nt, artificial
  Chemically synthesized
aaggguuuuuagacaggaa

SEQ ID NO: 317 - RNA, 19 nt, artificial
  Chemically synthesized
uugaaggguuuuuagacag

SEQ ID NO: 318 - RNA, 19 nt, artificial
  Chemically synthesized
caguuccugacucaaauuu

SEQ ID NO: 319 - RNA, 19 nt, artificial
  Chemically synthesized
accaguuccugacucaaau

SEQ ID NO: 320 - RNA, 19 nt, artificial
  Chemically synthesized
ccuaucaaaacuuccaaaa

SEQ ID NO: 321 - RNA, 19 nt, artificial
  Chemically synthesized
ugcuaagugauuuugacua

SEQ ID NO: 322 - RNA, 19 nt, artificial
  Chemically synthesized
uccacaauuugguuucagg

SEQ ID NO: 323 - RNA, 19 nt, artificial
  Chemically synthesized
ugauuccacaauuugguuu

SEQ ID NO: 324 - RNA, 19 nt, artificial
  Chemically synthesized
auagaucccauuuuuguac

SEQ ID NO: 325 - RNA, 19 nt, artificial
  Chemically synthesized
cagagagccugcuaaguga

SEQ ID NO: 326 - RNA, 19 nt, artificial
  Chemically synthesized
guagauuuucugcauagau

SEQ ID NO: 327 - RNA, 19 nt, artificial
  Chemically synthesized
uaguguagauuuucugcau

SEQ ID NO: 328 - RNA, 19 nt, artificial
  Chemically synthesized
auaguguagauuuucugca

SEQ ID NO: 329 - RNA, 19 nt, artificial
  Chemically synthesized
uguuucacauucauagcaa

SEQ ID NO: 330 - RNA, 19 nt, artificial
  Chemically synthesized
caccugcccuaaauaagaa

SEQ ID NO: 331 - RNA, 19 nt, artificial
  Chemically synthesized
aaagucauuuguaguuugc

SEQ ID NO: 332 - RNA, 19 nt, artificial
  Chemically synthesized
gcuagucagcuaaagucau

SEQ ID NO: 333 - RNA, 19 nt, artificial
  Chemically synthesized
ucagcuagucagcuaaagu

SEQ ID NO: 334 - RNA, 19 nt, artificial
  Chemically synthesized
ggguaguaaaacuauucag

SEQ ID NO: 335 - RNA, 19 nt, artificial
  Chemically synthesized
ccagcauuucagaauugcu

SEQ ID NO: 336 - RNA, 19 nt, artificial
  Chemically synthesized
cagcucaggauuucgacuu

SEQ ID NO: 337 - RNA, 19 nt, artificial
  Chemically synthesized
gaacucugauccucagcuc

SEQ ID NO: 338 - RNA, 19 nt, artificial
  Chemically synthesized
cgcuucuccucugguuuca

SEQ ID NO: 339 - RNA, 19 nt, artificial
  Chemically synthesized
gacuuuuucuuuaguagag

SEQ ID NO: 340 - RNA, 19 nt, artificial
  Chemically synthesized
ucagggacuuuuucuuuag

SEQ ID NO: 341 - RNA, 19 nt, artificial
  Chemically synthesized
uucagggacuuuuucuuua

SEQ ID NO: 342 - RNA, 19 nt, artificial
  Chemically synthesized
cuuuugagcuuacacuugu

SEQ ID NO: 343 - RNA, 19 nt, artificial
  Chemically synthesized
uaccuacuuuugagcuuac

SEQ ID NO: 344 - RNA, 19 nt, artificial
  Chemically synthesized
guaccuacuuuugagcuua

SEQ ID NO: 345 - RNA, 19 nt, artificial
  Chemically synthesized
gugaacuuggaaauugaaa

SEQ ID NO: 346 - RNA, 19 nt, artificial
  Chemically synthesized
gcacgugaacuuggaaauu

SEQ ID NO: 347 - RNA, 19 nt, artificial
  Chemically synthesized
ucccugagaaacugaccca

SEQ ID NO: 348 - RNA, 19 nt, artificial
  Chemically synthesized
agguccuugucccugagaa

SEQ ID NO: 349 - RNA, 19 nt, artificial
  Chemically synthesized
gcaaacuaaacuugguugc

SEQ ID NO: 350 - RNA, 19 nt, artificial
  Chemically synthesized
guccaaaucaaagcaaacu

SEQ ID NO: 351 - RNA, 19 nt, artificial
  Chemically synthesized
ucuguccaaaucaaagcaa

SEQ ID NO: 352 - RNA, 19 nt, artificial
  Chemically synthesized
ccuguuaugcuuacaaaau

SEQ ID NO: 353 - RNA, 19 nt, artificial
  Chemically synthesized
gccuguuaugcuuacaaaa

SEQ ID NO: 354 - RNA, 19 nt, artificial
  Chemically synthesized
caguuaucuuugacucucu

SEQ ID NO: 355 - RNA, 19 nt, artificial
  Chemically synthesized
cacuaacaguuaucuuuga

SEQ ID NO: 356 - RNA, 19 nt, artificial
  Chemically synthesized
uccacuaacaguuaucuuu

SEQ ID NO: 357 - RNA, 19 nt, artificial
  Chemically synthesized
agaacugucuguccaaauc

SEQ ID NO: 358 - RNA, 19 nt, artificial
  Chemically synthesized
ugacugggcaaggcuucuu

SEQ ID NO: 359 - RNA, 19 nt, artificial
  Chemically synthesized
ucacuguguuucugccgcu

SEQ ID NO: 360 - RNA, 19 nt, artificial
  Chemically synthesized
aagguucacuguguuucug

SEQ ID NO: 361 - RNA, 19 nt, artificial
  Chemically synthesized
ccaagauaaaucaauguug

SEQ ID NO: 362 - RNA, 19 nt, artificial
  Chemically synthesized
gauacuacaaagccaaucu

SEQ ID NO: 363 - RNA, 19 nt, artificial
  Chemically synthesized
aaagauacuacaaagccaa

SEQ ID NO: 364 - RNA, 19 nt, artificial
  Chemically synthesized
gaaagauacuacaaagcca

SEQ ID NO: 365 - RNA, 19 nt, artificial
  Chemically synthesized
uggaaagauacuacaaagc

SEQ ID NO: 366 - RNA, 19 nt, artificial
  Chemically synthesized
uuggaaagauacuacaaag

SEQ ID NO: 367 - RNA, 19 nt, artificial
  Chemically synthesized
ugcuuggaaagauacuaca

SEQ ID NO: 368 - RNA, 19 nt, artificial
  Chemically synthesized
augcuuggaaagauacuac

SEQ ID NO: 369 - RNA, 19 nt, artificial
  Chemically synthesized
cuaaacucuucaaaugcuu

SEQ ID NO: 370 - RNA, 19 nt, artificial
  Chemically synthesized
aagugaccuaaaaugucac

SEQ ID NO: 371 - RNA, 19 nt, artificial
  Chemically synthesized
ugauccuguuacugauacu

SEQ ID NO: 372 - RNA, 19 nt, artificial
  Chemically synthesized
acaggugugauccuguuac

SEQ ID NO: 373 - RNA, 19 nt, artificial
  Chemically synthesized
auccugguguuacugaaaa

SEQ ID NO: 374 - RNA, 19 nt, artificial
  Chemically synthesized
ggacagauguauucauccu

SEQ ID NO: 375 - RNA, 19 nt, artificial
  Chemically synthesized
agcuccacuucacaugcug

SEQ ID NO: 376 - RNA, 19 nt, artificial
  Chemically synthesized
agcuauuagcuccacuuca

SEQ ID NO: 377 - RNA, 19 nt, artificial
  Chemically synthesized
cuugccagaauuugguuaa

SEQ ID NO: 378 - RNA, 19 nt, artificial
  Chemically synthesized
aaggagcuuauucagguuu

SEQ ID NO: 379 - RNA, 19 nt, artificial
  Chemically synthesized
gcuuucauauccuugcugu

SEQ ID NO: 380 - RNA, 19 nt, artificial
  Chemically synthesized
ugagagaauuuagccucca

SEQ ID NO: 381 - RNA, 19 nt, artificial
  Chemically synthesized
augagagaauuuagccucc

SEQ ID NO: 382 - RNA, 19 nt, artificial
  Chemically synthesized
ggaaucaacuugccagaau

SEQ ID NO: 383 - RNA, 19 nt, artificial
  Chemically synthesized
uagggaauaauaaaggccu

SEQ ID NO: 384 - RNA, 19 nt, artificial
  Chemically synthesized
ucacuagggaauaauaaag

SEQ ID NO: 385 - RNA, 19 nt, artificial
  Chemically synthesized
accugucacuagggaauaa

SEQ ID NO: 386 - RNA, 19 nt, artificial
  Chemically synthesized
auaccugucacuagggaau

SEQ ID NO: 387 - RNA, 19 nt, artificial
  Chemically synthesized
uuggauaccugucacuagg

SEQ ID NO: 388 - RNA, 19 nt, artificial
  Chemically synthesized
caccuuggauaccugucac

SEQ ID NO: 389 - RNA, 19 nt, artificial
  Chemically synthesized
accguccagauaaccaugc

SEQ ID NO: 390 - RNA, 19 nt, artificial
  Chemically synthesized
gaagucugcauuggcuaug

SEQ ID NO: 391 - RNA, 19 nt, artificial
  Chemically synthesized
gaauuauugaaacggguca

SEQ ID NO: 392 - RNA, 19 nt, artificial
  Chemically synthesized
uaguagcuguauacuacca

SEQ ID NO: 393 - RNA, 19 nt, artificial
  Chemically synthesized
ggguaguagcuguauacua

SEQ ID NO: 394 - RNA, 19 nt, artificial
  Chemically synthesized
gucaaggguaguagcugua

SEQ ID NO: 395 - RNA, 19 nt, artificial
  Chemically synthesized
ugaaguaucucuccuuaac

SEQ ID NO: 396 - RNA, 19 nt, artificial
  Chemically synthesized
uugaaguaucucuccuuaa

SEQ ID NO: 397 - RNA, 19 nt, artificial
  Chemically synthesized
gggaauugaaguaucucuc

SEQ ID NO: 398 - RNA, 19 nt, artificial
  Chemically synthesized
ugggaauugaaguaucucu

SEQ ID NO: 399 - RNA, 19 nt, artificial
  Chemically synthesized
ggcuuuucugggaauugaa

SEQ ID NO: 400 - RNA, 19 nt, artificial
  Chemically synthesized
cccaaccucaacgagguaa

SEQ ID NO: 401 - RNA, 19 nt, artificial
  Chemically synthesized
gcaguguuaucucaucucu

SEQ ID NO: 402 - RNA, 19 nt, artificial
  Chemically synthesized
cucagaugaaccauuucac

SEQ ID NO: 403 - RNA, 19 nt, artificial
  Chemically synthesized
cugaacccaaccucaacga

SEQ ID NO: 404 - RNA, 19 nt, artificial
  Chemically synthesized
cugauucacuuaguaaucu

SEQ ID NO: 405 - RNA, 19 nt, artificial
  Chemically synthesized
cucugauucacuuaguaau

SEQ ID NO: 406 - RNA, 19 nt, artificial
  Chemically synthesized
ccucucugauucacuuagu

SEQ ID NO: 407 - RNA, 19 nt, artificial
  Chemically synthesized
aggaaacagagccguugac

SEQ ID NO: 408 - RNA, 19 nt, artificial
  Chemically synthesized
uacucuuccauugagugaa

SEQ ID NO: 409 - RNA, 19 nt, artificial
  Chemically synthesized
guguguaguugauuacucu

SEQ ID NO: 410 - RNA, 19 nt, artificial
  Chemically synthesized
gaacugauauuuuugugug

SEQ ID NO: 411 - RNA, 19 nt, artificial
  Chemically synthesized
aaguguugaauacugucuu

SEQ ID NO: 412 - RNA, 19 nt, artificial
  Chemically synthesized
uccccuguucuuaaguguu

SEQ ID NO: 413 - RNA, 19 nt, artificial
  Chemically synthesized
gcucaguuuccccuguucu

SEQ ID NO: 414 - RNA, 19 nt, artificial
  Chemically synthesized
agcucaguuuccccuguuc

SEQ ID NO: 415 - RNA, 19 nt, artificial
  Chemically synthesized
ggauuauguuguuccugaa

SEQ ID NO: 416 - RNA, 19 nt, artificial
  Chemically synthesized
uaagcucaguuuccccugu

SEQ ID NO: 417 - RNA, 19 nt, artificial
  Chemically synthesized
ugccuuuauaagcucaguu

SEQ ID NO: 418 - RNA, 19 nt, artificial
  Chemically synthesized
agaugccuuuauaagcuca

SEQ ID NO: 419 - RNA, 19 nt, artificial
  Chemically synthesized
uuagaugccuuuauaagcu

SEQ ID NO: 420 - RNA, 19 nt, artificial
  Chemically synthesized
cgguguuguuuuagaugcc

SEQ ID NO: 421 - RNA, 19 nt, artificial
  Chemically synthesized
uaaccacgguguuguuuua

SEQ ID NO: 422 - RNA, 19 nt, artificial
  Chemically synthesized
cuacugggauuauguuguu

SEQ ID NO: 423 - RNA, 19 nt, artificial
  Chemically synthesized
acuacugggauuauguugu

SEQ ID NO: 424 - RNA, 19 nt, artificial
  Chemically synthesized
auggaacugcuucacuguu

SEQ ID NO: 425 - RNA, 19 nt, artificial
  Chemically synthesized
uuacggcaauaauggaacu

SEQ ID NO: 426 - RNA, 19 nt, artificial
  Chemically synthesized
aggugaguuuaauuaaagc

SEQ ID NO: 427 - RNA, 19 nt, artificial
  Chemically synthesized
aggauuaaguaggugaguu

SEQ ID NO: 428 - RNA, 19 nt, artificial
  Chemically synthesized
acaggaagguaggauuaag

SEQ ID NO: 429 - RNA, 19 nt, artificial
  Chemically synthesized
aggguuuuuagacaggaag

SEQ ID NO: 430 - RNA, 19 nt, artificial
  Chemically synthesized
gaaggguuuuuagacagga

SEQ ID NO: 431 - RNA, 19 nt, artificial
  Chemically synthesized
ugaaggguuuuuagacagg

SEQ ID NO: 432 - RNA, 19 nt, artificial
  Chemically synthesized
uuugaaggguuuuuagaca

SEQ ID NO: 433 - RNA, 19 nt, artificial
  Chemically synthesized
gugauuuugacuacuggga

SEQ ID NO: 434 - RNA, 19 nt, artificial
  Chemically synthesized
uccugacucaaauuugaag

SEQ ID NO: 435 - RNA, 19 nt, artificial
  Chemically synthesized
ucucuaaguuuucagagga

SEQ ID NO: 436 - RNA, 19 nt, artificial
  Chemically synthesized
agguaggcuugguaauaga

SEQ ID NO: 437 - RNA, 19 nt, artificial
  Chemically synthesized
acaauuugguuucagguag

SEQ ID NO: 438 - RNA, 19 nt, artificial
  Chemically synthesized
guuuuacauuugauuccac

SEQ ID NO: 439 - RNA, 19 nt, artificial
  Chemically synthesized
aagcccauuugaguuuuac

SEQ ID NO: 440 - RNA, 19 nt, artificial
  Chemically synthesized
uagaagcccauuugaguuu

SEQ ID NO: 441 - RNA, 19 nt, artificial
  Chemically synthesized
aagcaaaaguagaagccca

SEQ ID NO: 442 - RNA, 19 nt, artificial
  Chemically synthesized
uagguaagcaaaaguagaa

SEQ ID NO: 443 - RNA, 19 nt, artificial
  Chemically synthesized
gaauagguaagcaaaagua

SEQ ID NO: 444 - RNA, 19 nt, artificial
  Chemically synthesized
ggauggaauagguaagcaa

SEQ ID NO: 445 - RNA, 19 nt, artificial
  Chemically synthesized
gggauggaauagguaagca

SEQ ID NO: 446 - RNA, 19 nt, artificial
  Chemically synthesized
agaauugaaugggauggaa

SEQ ID NO: 447 - RNA, 19 nt, artificial
  Chemically synthesized
cugcauagaucccauuuuu

SEQ ID NO: 448 - RNA, 19 nt, artificial
  Chemically synthesized
uagauuuucugcauagauc

SEQ ID NO: 449 - RNA, 19 nt, artificial
  Chemically synthesized
ggccuuuggagaagugauu

SEQ ID NO: 450 - RNA, 19 nt, artificial
  Chemically synthesized
acuguggcuaucacccaga

SEQ ID NO: 451 - RNA, 19 nt, artificial
  Chemically synthesized
ggcugauuuucuggccuuu

SEQ ID NO: 452 - RNA, 19 nt, artificial
  Chemically synthesized
acaggcugauuuucuggcc

SEQ ID NO: 453 - RNA, 19 nt, artificial
  Chemically synthesized
aacaggcugauuuucuggc

SEQ ID NO: 454 - RNA, 19 nt, artificial
  Chemically synthesized
cugcagcuaacaggcugau

SEQ ID NO: 455 - RNA, 19 nt, artificial
  Chemically synthesized
agcaacugcagcuaacagg

SEQ ID NO: 456 - RNA, 19 nt, artificial
  Chemically synthesized
uagcaacugcagcuaacag

SEQ ID NO: 457 - RNA, 19 nt, artificial
  Chemically synthesized
ucauagcaacugcagcuaa

SEQ ID NO: 458 - RNA, 19 nt, artificial
  Chemically synthesized
ucacauucauagcaacugc

SEQ ID NO: 459 - RNA, 19 nt, artificial
  Chemically synthesized
cagaauugcuggacugugg

SEQ ID NO: 460 - RNA, 19 nt, artificial
  Chemically synthesized
gcccuaaauaagaaacccc

SEQ ID NO: 461 - RNA, 19 nt, artificial
  Chemically synthesized
ccaccugcccuaaauaaga

SEQ ID NO: 462 - RNA, 19 nt, artificial
  Chemically synthesized
gucauuuguaguuugcccc

SEQ ID NO: 463 - RNA, 19 nt, artificial
  Chemically synthesized
guaaaacuauucagcuagu

SEQ ID NO: 464 - RNA, 19 nt, artificial
  Chemically synthesized
uuggguaguaaaacuauuc

SEQ ID NO: 465 - RNA, 19 nt, artificial
  Chemically synthesized
ccucagcucaggauuucga

SEQ ID NO: 466 - RNA, 19 nt, artificial
  Chemically synthesized
ggagaacucugauccucag

SEQ ID NO: 467 - RNA, 19 nt, artificial
  Chemically synthesized
ucgcuucuccucugguuuc

SEQ ID NO: 468 - RNA, 19 nt, artificial
  Chemically synthesized
gucgcuucuccucugguuu

SEQ ID NO: 469 - RNA, 19 nt, artificial
  Chemically synthesized
ggacuuuuucuuuaguaga

SEQ ID NO: 470 - RNA, 19 nt, artificial
  Chemically synthesized
uggacuagcuucagggacu

SEQ ID NO: 471 - RNA, 19 nt, artificial
  Chemically synthesized
ugcucauggacuagcuuca

SEQ ID NO: 472 - RNA, 19 nt, artificial
  Chemically synthesized
accuacuuuugagcuuaca

SEQ ID NO: 473 - RNA, 19 nt, artificial
  Chemically synthesized
ucguaccuacuuuugagcu

SEQ ID NO: 474 - RNA, 19 nt, artificial
  Chemically synthesized
cgucguaccuacuuuugag

SEQ ID NO: 475 - RNA, 19 nt, artificial
  Chemically synthesized
cacgugaacuuggaaauug

SEQ ID NO: 476 - RNA, 19 nt, artificial
  Chemically synthesized
ugcgagguuguguuaugca

SEQ ID NO: 477 - RNA, 19 nt, artificial
  Chemically synthesized
uugucccugagaaacugac

SEQ ID NO: 478 - RNA, 19 nt, artificial
  Chemically synthesized
uccuugucccugagaaacu

SEQ ID NO: 479 - RNA, 19 nt, artificial
  Chemically synthesized
ugaccaugguugcaacugg

SEQ ID NO: 480 - RNA, 19 nt, artificial
  Chemically synthesized
aacuaaacuugguugcuca

SEQ ID NO: 481 - RNA, 19 nt, artificial
  Chemically synthesized
agcaaacuaaacuugguug

SEQ ID NO: 482 - RNA, 19 nt, artificial
  Chemically synthesized
uguuaugcuuacaaaaugg

SEQ ID NO: 483 - RNA, 19 nt, artificial
  Chemically synthesized
acugucuguccaaaucaaa

SEQ ID NO: 484 - RNA, 19 nt, artificial
  Chemically synthesized
cuaacaguuaucuuugacu

SEQ ID NO: 485 - RNA, 19 nt, artificial
  Chemically synthesized
gggcaucgauguagaacug

SEQ ID NO: 486 - RNA, 19 nt, artificial
  Chemically synthesized
uccuggaguugucaccacu

SEQ ID NO: 487 - RNA, 19 nt, artificial
  Chemically synthesized
uuguuaagcuccaaagguu

SEQ ID NO: 488 - RNA, 19 nt, artificial
  Chemically synthesized
uugcaugucuauuguuaag

SEQ ID NO: 489 - RNA, 19 nt, artificial
  Chemically synthesized
auguuguuuugcaugucua

SEQ ID NO: 490 - RNA, 19 nt, artificial
  Chemically synthesized
aagauacuacaaagccaau

SEQ ID NO: 491 - RNA, 19 nt, artificial
  Chemically synthesized
cuuggaaagauacuacaaa

SEQ ID NO: 492 - RNA, 19 nt, artificial
  Chemically synthesized
ugucacuguucaaauuagc

SEQ ID NO: 493 - RNA, 19 nt, artificial
  Chemically synthesized
ugauacuauaagugaccua

SEQ ID NO: 494 - RNA, 19 nt, artificial
  Chemically synthesized
ccguugaccaugguugcaa

SEQ ID NO: 495 - RNA, 19 nt, artificial
  Chemically synthesized
guguuacugaaaaacaggu

SEQ ID NO: 496 - RNA, 19 nt, artificial
  Chemically synthesized
agggacagauguauucauc

SEQ ID NO: 497 - RNA, 19 nt, artificial
  Chemically synthesized
ggcguagggacagauguau

SEQ ID NO: 498 - RNA, 19 nt, artificial
  Chemically synthesized
cuccacuucacaugcugga

SEQ ID NO: 499 - RNA, 19 nt, artificial
  Chemically synthesized
uuccugcccuagcuauuag

SEQ ID NO: 500 - RNA, 19 nt, artificial
  Chemically synthesized
aggagcuuauucagguuuc

SEQ ID NO: 501 - RNA, 19 nt, artificial
  Chemically synthesized
auaaggagcuuauucaggu

SEQ ID NO: 502 - RNA, 19 nt, artificial
  Chemically synthesized
caacuugccagaauuuggu

SEQ ID NO: 503 - RNA, 19 nt, artificial
  Chemically synthesized
aauucagcaaggcuuucau

SEQ ID NO: 504 - RNA, 19 nt, artificial
  Chemically synthesized
ucaacaauguucaauucag

SEQ ID NO: 505 - RNA, 19 nt, artificial
  Chemically synthesized
uccacucaacaauguucaa

SEQ ID NO: 506 - RNA, 19 nt, artificial
  Chemically synthesized
uuccaacuaaguagaucau

SEQ ID NO: 507 - RNA, 19 nt, artificial
  Chemically synthesized
agggaauaauaaaggccuu

SEQ ID NO: 508 - RNA, 19 nt, artificial
  Chemically synthesized
cacuagggaauaauaaagg

SEQ ID NO: 509 - RNA, 19 nt, artificial
  Chemically synthesized
gaggaaucaacuugccaga

SEQ ID NO: 510 - RNA, 19 nt, artificial
  Chemically synthesized
ccugucacuagggaauaau

SEQ ID NO: 511 - RNA, 19 nt, artificial
  Chemically synthesized
caugcaugcacccagauuu

SEQ ID NO: 512 - RNA, 19 nt, artificial
  Chemically synthesized
guccagauaaccaugcaug

SEQ ID NO: 513 - RNA, 19 nt, artificial
  Chemically synthesized
ccguccagauaaccaugca

SEQ ID NO: 514 - RNA, 19 nt, artificial
  Chemically synthesized
gaaugaaacucaccgucca

SEQ ID NO: 515 - RNA, 19 nt, artificial
  Chemically synthesized
gagaaugaaacucaccguc

SEQ ID NO: 516 - RNA, 19 nt, artificial
  Chemically synthesized
acagccuagagaaugaaac

SEQ ID NO: 517 - RNA, 19 nt, artificial
  Chemically synthesized
cugcauuggcuauggagau

SEQ ID NO: 518 - RNA, 19 nt, artificial
  Chemically synthesized
agucugcauuggcuaugga

SEQ ID NO: 519 - RNA, 19 nt, artificial
  Chemically synthesized
aagucugcauuggcuaugg

SEQ ID NO: 520 - RNA, 19 nt, artificial
  Chemically synthesized
uugaauuauugaaacgggu

SEQ ID NO: 521 - RNA, 19 nt, artificial
  Chemically synthesized
gcuguauacuaccacuuug

SEQ ID NO: 522 - RNA, 19 nt, artificial
  Chemically synthesized
aaggguaguagcuguauac

SEQ ID NO: 523 - RNA, 19 nt, artificial
  Chemically synthesized
gaaguaucucuccuuaacc

SEQ ID NO: 524 - RNA, 19 nt, artificial
  Chemically synthesized
uucugggaauugaaguauc

SEQ ID NO: 525 - RNA, 19 nt, artificial
  Chemically synthesized
aacccaaccucaacgaggu

SEQ ID NO: 526 - RNA, 19 nt, artificial
  Chemically synthesized
augaaccauuucaccaugg

SEQ ID NO: 527 - RNA, 19 nt, artificial
  Chemically synthesized
agaugaaccauuucaccau

SEQ ID NO: 528 - RNA, 19 nt, artificial
  Chemically synthesized
aaucucagaugaaccauuu

SEQ ID NO: 529 - RNA, 19 nt, artificial
  Chemically synthesized
ugugcuuaaucucagauga

SEQ ID NO: 530 - RNA, 19 nt, artificial
  Chemically synthesized
augugcuuaaucucagaug

SEQ ID NO: 531 - RNA, 19 nt, artificial
  Chemically synthesized
acaugugcuuaaucucaga

SEQ ID NO: 532 - RNA, 19 nt, artificial
  Chemically synthesized
uacaugugcuuaaucucag

SEQ ID NO: 533 - RNA, 19 nt, artificial
  Chemically synthesized
ccucuuuucaguauuacau

SEQ ID NO: 534 - RNA, 19 nt, artificial
  Chemically synthesized
cucucugauucacuuagua

SEQ ID NO: 535 - RNA, 19 nt, artificial
  Chemically synthesized
auguuguuccugaacccaa

SEQ ID NO: 536 - RNA, 19 nt, artificial
  Chemically synthesized
cccuguucuuaaguguuga

SEQ ID NO: 537 - RNA, 19 nt, artificial
  Chemically synthesized
augccuuuauaagcucagu

SEQ ID NO: 538 - RNA, 19 nt, artificial
  Chemically synthesized
cugggauuauguuguuccu

SEQ ID NO: 539 - RNA, 19 nt, artificial
  Chemically synthesized
cuaauguuuuaaagaggca

SEQ ID NO: 540 - RNA, 19 nt, artificial
  Chemically synthesized
uugacuacugggauuaugu

SEQ ID NO: 541 - RNA, 19 nt, artificial
  Chemically synthesized
ugagaaauauuacggcaau

SEQ ID NO: 542 - RNA, 19 nt, artificial
  Chemically synthesized
augagaaauauuacggcaa

SEQ ID NO: 543 - RNA, 19 nt, artificial
  Chemically synthesized
gguaagaguaaaugagaaa

SEQ ID NO: 544 - RNA, 19 nt, artificial
  Chemically synthesized
cuagguaagaguaaaugag

SEQ ID NO: 545 - RNA, 19 nt, artificial
  Chemically synthesized
aacccuagguaagaguaaa

SEQ ID NO: 546 - RNA, 19 nt, artificial
  Chemically synthesized
ggugaguuuaauuaaagcu

SEQ ID NO: 547 - RNA, 19 nt, artificial
  Chemically synthesized
uagacaggaagguaggauu

SEQ ID NO: 548 - RNA, 19 nt, artificial
  Chemically synthesized
ugacucaaauuugaagggu

SEQ ID NO: 549 - RNA, 19 nt, artificial
  Chemically synthesized
cugacucaaauuugaaggg

SEQ ID NO: 550 - RNA, 19 nt, artificial
  Chemically synthesized
caccaguuccugacucaaa

SEQ ID NO: 551 - RNA, 19 nt, artificial
  Chemically synthesized
accaccaguuccugacuca

SEQ ID NO: 552 - RNA, 19 nt, artificial
  Chemically synthesized
aaagcccacaccaccaguu

SEQ ID NO: 553 - RNA, 19 nt, artificial
  Chemically synthesized
uaggcuugguaauagacua

SEQ ID NO: 554 - RNA, 19 nt, artificial
  Chemically synthesized
caauuugguuucagguagg

SEQ ID NO: 555 - RNA, 19 nt, artificial
  Chemically synthesized
agcccauuugaguuuuaca

SEQ ID NO: 556 - RNA, 19 nt, artificial
  Chemically synthesized
gccugcuaagugauuuuga

SEQ ID NO: 557 - RNA, 19 nt, artificial
  Chemically synthesized
agcaaaaguagaagcccau

SEQ ID NO: 558 - RNA, 19 nt, artificial
  Chemically synthesized
guaagcaaaaguagaagcc

SEQ ID NO: 559 - RNA, 19 nt, artificial
  Chemically synthesized
gagagccugcuaagugauu

SEQ ID NO: 560 - RNA, 19 nt, artificial
  Chemically synthesized
gcauagaucccauuuuugu

SEQ ID NO: 561 - RNA, 19 nt, artificial
  Chemically synthesized
aguguagauuuucugcaua

SEQ ID NO: 562 - RNA, 19 nt, artificial
  Chemically synthesized
uggagaagugauucaaaau

SEQ ID NO: 563 - RNA, 19 nt, artificial
  Chemically synthesized
acugcagcuaacaggcuga

SEQ ID NO: 564 - RNA, 19 nt, artificial
  Chemically synthesized
cuguguuucacauucauag

SEQ ID NO: 565 - RNA, 19 nt, artificial
  Chemically synthesized
uucuguguuucacauucau

SEQ ID NO: 566 - RNA, 19 nt, artificial
  Chemically synthesized
cccaaauguagucucuuuu

SEQ ID NO: 567 - RNA, 19 nt, artificial
  Chemically synthesized
ccccaaauguagucucuuu

SEQ ID NO: 568 - RNA, 19 nt, artificial
  Chemically synthesized
aaccccaaauguagucucu

SEQ ID NO: 569 - RNA, 19 nt, artificial
  Chemically synthesized
cugcccuaaauaagaaacc

SEQ ID NO: 570 - RNA, 19 nt, artificial
  Chemically synthesized
accugcccuaaauaagaaa

SEQ ID NO: 571 - RNA, 19 nt, artificial
  Chemically synthesized
cccaccugcccuaaauaag

SEQ ID NO: 572 - RNA, 19 nt, artificial
  Chemically synthesized
cucacugauuggaacaaca

SEQ ID NO: 573 - RNA, 19 nt, artificial
  Chemically synthesized
cucaggauuucgacuuguu

SEQ ID NO: 574 - RNA, 19 nt, artificial
  Chemically synthesized
gcucaggauuucgacuugu

SEQ ID NO: 575 - RNA, 19 nt, artificial
  Chemically synthesized
agcucaggauuucgacuug

SEQ ID NO: 576 - RNA, 19 nt, artificial
  Chemically synthesized
aggagaacucugauccuca

SEQ ID NO: 577 - RNA, 19 nt, artificial
  Chemically synthesized
ggcaguuugagcagcaaga

SEQ ID NO: 578 - RNA, 19 nt, artificial
  Chemically synthesized
ugagcuuacacuuguguuu

SEQ ID NO: 579 - RNA, 19 nt, artificial
  Chemically synthesized
uuugagcuuacacuugugu

SEQ ID NO: 580 - RNA, 19 nt, artificial
  Chemically synthesized
gugugugauucuagcgucg

SEQ ID NO: 581 - RNA, 19 nt, artificial
  Chemically synthesized
uugugugugauucuagcgu

SEQ ID NO: 582 - RNA, 19 nt, artificial
  Chemically synthesized
uggauaggauuguguguga

SEQ ID NO: 583 - RNA, 19 nt, artificial
  Chemically synthesized
aaaagcuggauaggauugu

SEQ ID NO: 584 - RNA, 19 nt, artificial
  Chemically synthesized
guauguaaaaagcuggaua

SEQ ID NO: 585 - RNA, 19 nt, artificial
  Chemically synthesized
auguauguaaaaagcugga

SEQ ID NO: 586 - RNA, 19 nt, artificial
  Chemically synthesized
cugacccagagaauugcuc

SEQ ID NO: 587 - RNA, 19 nt, artificial
  Chemically synthesized
augguugcaacuggcaguu

SEQ ID NO: 588 - RNA, 19 nt, artificial
  Chemically synthesized
uggaaggcuguuaaauuaa

SEQ ID NO: 589 - RNA, 19 nt, artificial
  Chemically synthesized
gcuuauggaaggcuguuaa

SEQ ID NO: 590 - RNA, 19 nt, artificial
  Chemically synthesized
cugucuguccaaaucaaag

SEQ ID NO: 591 - RNA, 19 nt, artificial
  Chemically synthesized
auguagaacuguuguccuu

SEQ ID NO: 592 - RNA, 19 nt, artificial
  Chemically synthesized
gcaucgauguagaacuguu

SEQ ID NO: 593 - RNA, 19 nt, artificial
  Chemically synthesized
aauguuguuuugcaugucu

SEQ ID NO: 594 - RNA, 19 nt, artificial
  Chemically synthesized
ugggccaagauaaaucaau

SEQ ID NO: 595 - RNA, 19 nt, artificial
  Chemically synthesized
gaauugggccaagauaaau

SEQ ID NO: 596 - RNA, 19 nt, artificial
  Chemically synthesized
agaauugggccaagauaaa

SEQ ID NO: 597 - RNA, 19 nt, artificial
  Chemically synthesized
cucuucaaaugcuuggaaa

SEQ ID NO: 598 - RNA, 19 nt, artificial
  Chemically synthesized
acucuucaaaugcuuggaa

SEQ ID NO: 599 - RNA, 19 nt, artificial
  Chemically synthesized
gucacuguucaaauuagcc

SEQ ID NO: 600 - RNA, 19 nt, artificial
  Chemically synthesized
gugaccuaaaaugucacug

SEQ ID NO: 601 - RNA, 19 nt, artificial
  Chemically synthesized
cugauacuauaagugaccu

SEQ ID NO: 602 - RNA, 19 nt, artificial
  Chemically synthesized
acugauacuauaagugacc

SEQ ID NO: 603 - RNA, 19 nt, artificial
  Chemically synthesized
uacugauacuauaagugac

SEQ ID NO: 604 - RNA, 19 nt, artificial
  Chemically synthesized
gauccuguuacugauacua

SEQ ID NO: 605 - RNA, 19 nt, artificial
  Chemically synthesized
ggugugauccuguuacuga

SEQ ID NO: 606 - RNA, 19 nt, artificial
  Chemically synthesized
cugaaaaacaggugugauc

SEQ ID NO: 607 - RNA, 19 nt, artificial
  Chemically synthesized
ugguguuacugaaaaacag

SEQ ID NO: 608 - RNA, 19 nt, artificial
  Chemically synthesized
cugguguuacugaaaaaca

SEQ ID NO: 609 - RNA, 19 nt, artificial
  Chemically synthesized
uccugguguuacugaaaaa

SEQ ID NO: 610 - RNA, 19 nt, artificial
  Chemically synthesized
acagauguauucauccugg

SEQ ID NO: 611 - RNA, 19 nt, artificial
  Chemically synthesized
gacagauguauucauccug

SEQ ID NO: 612 - RNA, 19 nt, artificial
  Chemically synthesized
gcguagggacagauguauu

SEQ ID NO: 613 - RNA, 19 nt, artificial
  Chemically synthesized
uccugcccuagcuauuagc

SEQ ID NO: 614 - RNA, 19 nt, artificial
  Chemically synthesized
guggauaaggagcuuauuc

SEQ ID NO: 615 - RNA, 19 nt, artificial
  Chemically synthesized
ugcugugggucguggauaa

SEQ ID NO: 616 - RNA, 19 nt, artificial
  Chemically synthesized
gaaucaacuugccagaauu

SEQ ID NO: 617 - RNA, 19 nt, artificial
  Chemically synthesized
ccaacuaaguagaucauua

SEQ ID NO: 618 - RNA, 19 nt, artificial
  Chemically synthesized
aaaggccuuauuuuuuguc

SEQ ID NO: 619 - RNA, 19 nt, artificial
  Chemically synthesized
ggaauaauaaaggccuuau

SEQ ID NO: 620 - RNA, 19 nt, artificial
  Chemically synthesized
gggaauaauaaaggccuua

SEQ ID NO: 621 - RNA, 19 nt, artificial
  Chemically synthesized
aaccaugcaugcacccaga

SEQ ID NO: 622 - RNA, 19 nt, artificial
  Chemically synthesized
cagauaaccaugcaugcac

SEQ ID NO: 623 - RNA, 19 nt, artificial
  Chemically synthesized
cucaccguccagauaacca

SEQ ID NO: 624 - RNA, 19 nt, artificial
  Chemically synthesized
augaaacucaccguccaga

SEQ ID NO: 625 - RNA, 19 nt, artificial
  Chemically synthesized
agagaaugaaacucaccgu

SEQ ID NO: 626 - RNA, 19 nt, artificial
  Chemically synthesized
guacagccuagagaaugaa

SEQ ID NO: 627 - RNA, 19 nt, artificial
  Chemically synthesized
augguuuauaguacagccu

SEQ ID NO: 628 - RNA, 19 nt, artificial
  Chemically synthesized
auggagauaugguuuauag

SEQ ID NO: 629 - RNA, 19 nt, artificial
  Chemically synthesized
uggcuauggagauaugguu

SEQ ID NO: 630 - RNA, 19 nt, artificial
  Chemically synthesized
ugcauuggcuauggagaua

SEQ ID NO: 631 - RNA, 19 nt, artificial
  Chemically synthesized
guauacuaccacuuugaau

SEQ ID NO: 632 - RNA, 19 nt, artificial
  Chemically synthesized
agcuguauacuaccacuuu

SEQ ID NO: 633 - RNA, 19 nt, artificial
  Chemically synthesized
gguaguagcuguauacuac

SEQ ID NO: 634 - RNA, 19 nt, artificial
  Chemically synthesized
caaggguaguagcuguaua

SEQ ID NO: 635 - RNA, 19 nt, artificial
  Chemically synthesized
uccuuaaccccaauuguca

SEQ ID NO: 636 - RNA, 19 nt, artificial
  Chemically synthesized
aaguaucucuccuuaaccc

SEQ ID NO: 637 - RNA, 19 nt, artificial
  Chemically synthesized
ucugggaauugaaguaucu

SEQ ID NO: 638 - RNA, 19 nt, artificial
  Chemically synthesized
uuucugggaauugaaguau

SEQ ID NO: 639 - RNA, 19 nt, artificial
  Chemically synthesized
ggcaguguuaucucaucuc

SEQ ID NO: 640 - RNA, 19 nt, artificial
  Chemically synthesized
auggcaguguuaucucauc

SEQ ID NO: 641 - RNA, 19 nt, artificial
  Chemically synthesized
caccauggcaguguuaucu

SEQ ID NO: 642 - RNA, 19 nt, artificial
  Chemically synthesized
ugcuuaaucucagaugaac

SEQ ID NO: 643 - RNA, 19 nt, artificial
  Chemically synthesized
caugugcuuaaucucagau

SEQ ID NO: 644 - RNA, 19 nt, artificial
  Chemically synthesized
uuacaugugcuuaaucuca

SEQ ID NO: 645 - RNA, 19 nt, artificial
  Chemically synthesized
caguauuacaugugcuuaa

SEQ ID NO: 646 - RNA, 19 nt, artificial
  Chemically synthesized
ucacuuaguaaucuauccu

SEQ ID NO: 647 - RNA, 19 nt, artificial
  Chemically synthesized
cugugaggauaggaaauua

SEQ ID NO: 648 - RNA, 19 nt, artificial
  Chemically synthesized
aguguugaauacugucuuu

SEQ ID NO: 649 - RNA, 19 nt, artificial
  Chemically synthesized
uaaguguugaauacugucu

SEQ ID NO: 650 - RNA, 19 nt, artificial
  Chemically synthesized
cuguucuuaaguguugaau

SEQ ID NO: 651 - RNA, 19 nt, artificial
  Chemically synthesized
ccuguucuuaaguguugaa

SEQ ID NO: 652 - RNA, 19 nt, artificial
  Chemically synthesized
gaugccuuuauaagcucag

SEQ ID NO: 653 - RNA, 19 nt, artificial
  Chemically synthesized
uagaugccuuuauaagcuc

SEQ ID NO: 654 - RNA, 19 nt, artificial
  Chemically synthesized
gguguuguuuuagaugccu

SEQ ID NO: 655 - RNA, 19 nt, artificial
  Chemically synthesized
uaaagaggcaacaaaagcu

SEQ ID NO: 656 - RNA, 19 nt, artificial
  Chemically synthesized
guuuuaaagaggcaacaaa

SEQ ID NO: 657 - RNA, 19 nt, artificial
  Chemically synthesized
auguuuuaaagaggcaaca

SEQ ID NO: 658 - RNA, 19 nt, artificial
  Chemically synthesized
gcuucacuguuucuuggug

SEQ ID NO: 659 - RNA, 19 nt, artificial
  Chemically synthesized
gagaaauauuacggcaaua

SEQ ID NO: 660 - RNA, 19 nt, artificial
  Chemically synthesized
acucaaauuugaaggguuu

SEQ ID NO: 661 - RNA, 19 nt, artificial
  Chemically synthesized
aagugauuuugacuacugg

SEQ ID NO: 662 - RNA, 19 nt, artificial
  Chemically synthesized
uaagugauuuugacuacug

SEQ ID NO: 663 - RNA, 19 nt, artificial
  Chemically synthesized
cacagaaucauacuaaaug

SEQ ID NO: 664 - RNA, 19 nt, artificial
  Chemically synthesized
gcuaagugauuuugacuac

SEQ ID NO: 665 - RNA, 19 nt, artificial
  Chemically synthesized
cagguaggcuugguaauag

SEQ ID NO: 666 - RNA, 19 nt, artificial
  Chemically synthesized
ugggauggaauagguaagc

SEQ ID NO: 667 - RNA, 19 nt, artificial
  Chemically synthesized
augggauggaauagguaag

SEQ ID NO: 668 - RNA, 19 nt, artificial
  Chemically synthesized
uagucucuuuucuuucugu

SEQ ID NO: 669 - RNA, 19 nt, artificial
  Chemically synthesized
aagaaaccccaaauguagu

SEQ ID NO: 670 - RNA, 19 nt, artificial
  Chemically synthesized
cccuaaauaagaaacccca

SEQ ID NO: 671 - RNA, 19 nt, artificial
  Chemically synthesized
gaacaacagugauugaagg

SEQ ID NO: 672 - RNA, 19 nt, artificial
  Chemically synthesized
cugauuggaacaacaguga

SEQ ID NO: 673 - RNA, 19 nt, artificial
  Chemically synthesized
gauccucagcucaggauuu

SEQ ID NO: 674 - RNA, 19 nt, artificial
  Chemically synthesized
uucaggagaacucugaucc

SEQ ID NO: 675 - RNA, 19 nt, artificial
  Chemically synthesized
uaguagaggucgcuucucc

SEQ ID NO: 676 - RNA, 19 nt, artificial
  Chemically synthesized
gcuucagggacuuuuucuu

SEQ ID NO: 677 - RNA, 19 nt, artificial
  Chemically synthesized
aagcaggagaacugcucau

SEQ ID NO: 678 - RNA, 19 nt, artificial
  Chemically synthesized
gagcuuacacuuguguuua

SEQ ID NO: 679 - RNA, 19 nt, artificial
  Chemically synthesized
gugugauucuagcgucgua

SEQ ID NO: 680 - RNA, 19 nt, artificial
  Chemically synthesized
aggauugugugugauucua

SEQ ID NO: 681 - RNA, 19 nt, artificial
  Chemically synthesized
gguccuugucccugagaaa

SEQ ID NO: 682 - RNA, 19 nt, artificial
  Chemically synthesized
acaaaauggugauggcuua

SEQ ID NO: 683 - RNA, 19 nt, artificial
  Chemically synthesized
cucucuugccuguuaugcu

SEQ ID NO: 684 - RNA, 19 nt, artificial
  Chemically synthesized
aucuuugacucucuugccu

SEQ ID NO: 685 - RNA, 19 nt, artificial
  Chemically synthesized
uuccacuaacaguuaucuu

SEQ ID NO: 686 - RNA, 19 nt, artificial
  Chemically synthesized
ucgauguagaacuguuguc

SEQ ID NO: 687 - RNA, 19 nt, artificial
  Chemically synthesized
ucuugggcaucgauguaga

SEQ ID NO: 688 - RNA, 19 nt, artificial
  Chemically synthesized
aaggcuucuugggcaucga

SEQ ID NO: 689 - RNA, 19 nt, artificial
  Chemically synthesized
gucuauuguuaagcuccaa

SEQ ID NO: 690 - RNA, 19 nt, artificial
  Chemically synthesized
ugucuauuguuaagcucca

SEQ ID NO: 691 - RNA, 19 nt, artificial
  Chemically synthesized
ugcaugucuauuguuaagc

SEQ ID NO: 692 - RNA, 19 nt, artificial
  Chemically synthesized
uguuuugcaugucuauugu

SEQ ID NO: 693 - RNA, 19 nt, artificial
  Chemically synthesized
uuguuuugcaugucuauug

SEQ ID NO: 694 - RNA, 19 nt, artificial
  Chemically synthesized
agugaccuaaaaugucacu

SEQ ID NO: 695 - RNA, 19 nt, artificial
  Chemically synthesized
guuacugauacuauaagug

SEQ ID NO: 696 - RNA, 19 nt, artificial
  Chemically synthesized
aaacaggugugauccuguu

SEQ ID NO: 697 - RNA, 19 nt, artificial
  Chemically synthesized
ucauccugguguuacugaa

SEQ ID NO: 698 - RNA, 19 nt, artificial
  Chemically synthesized
gauguauucauccuggugu

SEQ ID NO: 699 - RNA, 19 nt, artificial
  Chemically synthesized
cuagcuauuagcuccacuu

SEQ ID NO: 700 - RNA, 19 nt, artificial
  Chemically synthesized
uaaggagcuuauucagguu

SEQ ID NO: 701 - RNA, 19 nt, artificial
  Chemically synthesized
gucguggauaaggagcuua

SEQ ID NO: 702 - RNA, 19 nt, artificial
  Chemically synthesized
ugugggucguggauaagga

SEQ ID NO: 703 - RNA, 19 nt, artificial
  Chemically synthesized
uucauauccuugcuguggg

SEQ ID NO: 704 - RNA, 19 nt, artificial
  Chemically synthesized
uaaugagagaauuuagccu

SEQ ID NO: 705 - RNA, 19 nt, artificial
  Chemically synthesized
guuaaugagagaauuuagc

SEQ ID NO: 706 - RNA, 19 nt, artificial
  Chemically synthesized
cuuauuccaacuaaguaga

SEQ ID NO: 707 - RNA, 19 nt, artificial
  Chemically synthesized
uugucuuauuccaacuaag

SEQ ID NO: 708 - RNA, 19 nt, artificial
  Chemically synthesized
gucacuagggaauaauaaa

SEQ ID NO: 709 - RNA, 19 nt, artificial
  Chemically synthesized
cugucacuagggaauaaua

SEQ ID NO: 710 - RNA, 19 nt, artificial
  Chemically synthesized
cguccagauaaccaugcau

SEQ ID NO: 711 - RNA, 19 nt, artificial
  Chemically synthesized
uagagaaugaaacucaccg

SEQ ID NO: 712 - RNA, 19 nt, artificial
  Chemically synthesized
cuaccacuuugaauuauug

SEQ ID NO: 713 - RNA, 19 nt, artificial
  Chemically synthesized
ugucaaggguaguagcugu

SEQ ID NO: 714 - RNA, 19 nt, artificial
  Chemically synthesized
cucuccuuaaccccaauug

SEQ ID NO: 715 - RNA, 19 nt, artificial
  Chemically synthesized
gaugaaccauuucaccaug

SEQ ID NO: 716 - RNA, 19 nt, artificial
  Chemically synthesized
uuucaguauuacaugugcu

SEQ ID NO: 717 - RNA, 19 nt, artificial
  Chemically synthesized
uuccugaacccaaccucaa

SEQ ID NO: 718 - RNA, 19 nt, artificial
  Chemically synthesized
guaaucuauccucuuuuca

SEQ ID NO: 719 - RNA, 19 nt, artificial
  Chemically synthesized
uuguuccugaacccaaccu

SEQ ID NO: 720 - RNA, 19 nt, artificial
  Chemically synthesized
ggaaauuaguucugagauc

SEQ ID NO: 721 - RNA, 19 nt, artificial
  Chemically synthesized
aggauaggaaauuaguucu

SEQ ID NO: 722 - RNA, 19 nt, artificial
  Chemically synthesized
ugugaggauaggaaauuag

SEQ ID NO: 723 - RNA, 19 nt, artificial
  Chemically synthesized
ccugugaggauaggaaauu

SEQ ID NO: 724 - RNA, 19 nt, artificial
  Chemically synthesized
cugauauuuuuguguguag

SEQ ID NO: 725 - RNA, 19 nt, artificial
  Chemically synthesized
guucuuaaguguugaauac

SEQ ID NO: 726 - RNA, 19 nt, artificial
  Chemically synthesized
acugggauuauguuguucc

SEQ ID NO: 727 - RNA, 19 nt, artificial
  Chemically synthesized
ggugacuuccucacucuaa

SEQ ID NO: 728 - RNA, 19 nt, artificial
  Chemically synthesized
uuggugacuuccucacucu

SEQ ID NO: 729 - RNA, 19 nt, artificial
  Chemically synthesized
cacuguuucuuggugacuu

SEQ ID NO: 730 - RNA, 19 nt, artificial
  Chemically synthesized
cuucacuguuucuugguga

SEQ ID NO: 731 - RNA, 19 nt, artificial
  Chemically synthesized
uauuacggcaauaauggaa

SEQ ID NO: 732 - RNA, 19 nt, artificial
  Chemically synthesized
uagguaagaguaaaugaga

SEQ ID NO: 733 - RNA, 19 nt, artificial
  Chemically synthesized
cccuagguaagaguaaaug

SEQ ID NO: 734 - RNA, 19 nt, artificial
  Chemically synthesized
uuagacaggaagguaggau

SEQ ID NO: 735 - RNA, 19 nt, artificial
  Chemically synthesized
cuaagugauuuugacuacu

SEQ ID NO: 736 - RNA, 19 nt, artificial
  Chemically synthesized
agaagcccauuugaguuuu

SEQ ID NO: 737 - RNA, 19 nt, artificial
  Chemically synthesized
guagaagcccauuugaguu

SEQ ID NO: 738 - RNA, 19 nt, artificial
  Chemically synthesized
aaguagaagcccauuugag

SEQ ID NO: 739 - RNA, 19 nt, artificial
  Chemically synthesized
caaaaguagaagcccauuu

SEQ ID NO: 740 - RNA, 19 nt, artificial
  Chemically synthesized
agccugcuaagugauuuug

SEQ ID NO: 741 - RNA, 19 nt, artificial
  Chemically synthesized
gguaagcaaaaguagaagc

SEQ ID NO: 742 - RNA, 19 nt, artificial
  Chemically synthesized
agguaagcaaaaguagaag

SEQ ID NO: 743 - RNA, 19 nt, artificial
  Chemically synthesized
uggaauagguaagcaaaag

SEQ ID NO: 744 - RNA, 19 nt, artificial
  Chemically synthesized
auggaauagguaagcaaaa

SEQ ID NO: 745 - RNA, 19 nt, artificial
  Chemically synthesized
uugaaugggauggaauagg

SEQ ID NO: 746 - RNA, 19 nt, artificial
  Chemically synthesized
agagccugcuaagugauuu

SEQ ID NO: 747 - RNA, 19 nt, artificial
  Chemically synthesized
ucugcauagaucccauuuu

SEQ ID NO: 748 - RNA, 19 nt, artificial
  Chemically synthesized
uucuggccuuuggagaagu

SEQ ID NO: 749 - RNA, 19 nt, artificial
  Chemically synthesized
uuucuguguuucacauuca

SEQ ID NO: 750 - RNA, 19 nt, artificial
  Chemically synthesized
guagucucuuuucuuucug

SEQ ID NO: 751 - RNA, 19 nt, artificial
  Chemically synthesized
gaaaccccaaauguagucu

SEQ ID NO: 752 - RNA, 19 nt, artificial
  Chemically synthesized
guaguaaaacuauucagcu

SEQ ID NO: 753 - RNA, 19 nt, artificial
  Chemically synthesized
gguaguaaaacuauucagc

SEQ ID NO: 754 - RNA, 19 nt, artificial
  Chemically synthesized
gauuggaacaacagugauu

SEQ ID NO: 755 - RNA, 19 nt, artificial
  Chemically synthesized
uacucacugauuggaacaa

SEQ ID NO: 756 - RNA, 19 nt, artificial
  Chemically synthesized
gauuucgacuuguuaagaa

SEQ ID NO: 757 - RNA, 19 nt, artificial
  Chemically synthesized
aggauuucgacuuguuaag

SEQ ID NO: 758 - RNA, 19 nt, artificial
  Chemically synthesized
ucaggagaacucugauccu

SEQ ID NO: 759 - RNA, 19 nt, artificial
  Chemically synthesized
ggacuagcuucagggacuu

SEQ ID NO: 760 - RNA, 19 nt, artificial
  Chemically synthesized
cucauggacuagcuucagg

SEQ ID NO: 761 - RNA, 19 nt, artificial
  Chemically synthesized
gagaacugcucauggacua

SEQ ID NO: 762 - RNA, 19 nt, artificial
  Chemically synthesized
ggagaacugcucauggacu

SEQ ID NO: 763 - RNA, 19 nt, artificial
  Chemically synthesized
caggagaacugcucaugga

SEQ ID NO: 764 - RNA, 19 nt, artificial
  Chemically synthesized
gcuuacacuuguguuuaag

SEQ ID NO: 765 - RNA, 19 nt, artificial
  Chemically synthesized
ggauugugugugauucuag

SEQ ID NO: 766 - RNA, 19 nt, artificial
  Chemically synthesized
ggauaggauugugugugau

SEQ ID NO: 767 - RNA, 19 nt, artificial
  Chemically synthesized
gguugcaacuggcaguuug

SEQ ID NO: 768 - RNA, 19 nt, artificial
  Chemically synthesized
uaaacuugguugcucaaag

SEQ ID NO: 769 - RNA, 19 nt, artificial
  Chemically synthesized
ggcuuauggaaggcuguua

SEQ ID NO: 770 - RNA, 19 nt, artificial
  Chemically synthesized
aaauggugauggcuuaugg

SEQ ID NO: 771 - RNA, 19 nt, artificial
  Chemically synthesized
ucucuugccuguuaugcuu

SEQ ID NO: 772 - RNA, 19 nt, artificial
  Chemically synthesized
uucuugggcaucgauguag

SEQ ID NO: 773 - RNA, 19 nt, artificial
  Chemically synthesized
aagcuccaaagguucacug

SEQ ID NO: 774 - RNA, 19 nt, artificial
  Chemically synthesized
ucuauuguuaagcuccaaa

SEQ ID NO: 775 - RNA, 19 nt, artificial
  Chemically synthesized
gggccaagauaaaucaaug

SEQ ID NO: 776 - RNA, 19 nt, artificial
  Chemically synthesized
uagaauugggccaagauaa

SEQ ID NO: 777 - RNA, 19 nt, artificial
  Chemically synthesized
ggaaagauacuacaaagcc

SEQ ID NO: 778 - RNA, 19 nt, artificial
  Chemically synthesized
ucaaaugcuuggaaagaua

SEQ ID NO: 779 - RNA, 19 nt, artificial
  Chemically synthesized
guuacugaaaaacaggugu

SEQ ID NO: 780 - RNA, 19 nt, artificial
  Chemically synthesized
auguauucauccugguguu

SEQ ID NO: 781 - RNA, 19 nt, artificial
  Chemically synthesized
cagauguauucauccuggu

SEQ ID NO: 782 - RNA, 19 nt, artificial
  Chemically synthesized
ugcccuagcuauuagcucc

SEQ ID NO: 783 - RNA, 19 nt, artificial
  Chemically synthesized
gagcuuauucagguuuccu

SEQ ID NO: 784 - RNA, 19 nt, artificial
  Chemically synthesized
ggagcuuauucagguuucc

SEQ ID NO: 785 - RNA, 19 nt, artificial
  Chemically synthesized
ucauauccuugcugugggu

SEQ ID NO: 786 - RNA, 19 nt, artificial
  Chemically synthesized
guucaauucagcaaggcuu

SEQ ID NO: 787 - RNA, 19 nt, artificial
  Chemically synthesized
caacaauguucaauucagc

SEQ ID NO: 788 - RNA, 19 nt, artificial
  Chemically synthesized
gucuuauuccaacuaagua

SEQ ID NO: 789 - RNA, 19 nt, artificial
  Chemically synthesized
cuagggaauaauaaaggcc

SEQ ID NO: 790 - RNA, 19 nt, artificial
  Chemically synthesized
uaaccaugcaugcacccag

SEQ ID NO: 791 - RNA, 19 nt, artificial
  Chemically synthesized
agauaaccaugcaugcacc

SEQ ID NO: 792 - RNA, 19 nt, artificial
  Chemically synthesized
agccuagagaaugaaacuc

SEQ ID NO: 793 - RNA, 19 nt, artificial
  Chemically synthesized
uuauaguacagccuagaga

SEQ ID NO: 794 - RNA, 19 nt, artificial
  Chemically synthesized
gcuauggagauaugguuua

SEQ ID NO: 795 - RNA, 19 nt, artificial
  Chemically synthesized
ucucuccuuaaccccaauu

SEQ ID NO: 796 - RNA, 19 nt, artificial
  Chemically synthesized
aucucuccuuaaccccaau

SEQ ID NO: 797 - RNA, 19 nt, artificial
  Chemically synthesized
cugggcuuuucugggaauu

SEQ ID NO: 798 - RNA, 19 nt, artificial
  Chemically synthesized
aaccauuucaccauggcag

SEQ ID NO: 799 - RNA, 19 nt, artificial
  Chemically synthesized
uucaguauuacaugugcuu

SEQ ID NO: 800 - RNA, 19 nt, artificial
  Chemically synthesized
uccucuuuucaguauuaca

SEQ ID NO: 801 - RNA, 19 nt, artificial
  Chemically synthesized
auccucuuuucaguauuac

SEQ ID NO: 802 - RNA, 19 nt, artificial
  Chemically synthesized
cuauccucuuuucaguauu

SEQ ID NO: 803 - RNA, 19 nt, artificial
  Chemically synthesized
aaucuauccucuuuucagu

SEQ ID NO: 804 - RNA, 19 nt, artificial
  Chemically synthesized
uucacuuaguaaucuaucc

SEQ ID NO: 805 - RNA, 19 nt, artificial
  Chemically synthesized
uaggaaauuaguucugaga

SEQ ID NO: 806 - RNA, 19 nt, artificial
  Chemically synthesized
ggauaggaaauuaguucug

SEQ ID NO: 807 - RNA, 19 nt, artificial
  Chemically synthesized
gaggauaggaaauuaguuc

SEQ ID NO: 808 - RNA, 19 nt, artificial
  Chemically synthesized
gugaggauaggaaauuagu

SEQ ID NO: 809 - RNA, 19 nt, artificial
  Chemically synthesized
guaggcuugguaauagacu

SEQ ID NO: 810 - RNA, 19 nt, artificial
  Chemically synthesized
ccugcuaagugauuuugac

SEQ ID NO: 811 - RNA, 19 nt, artificial
  Chemically synthesized
ugcauagaucccauuuuug

SEQ ID NO: 812 - RNA, 19 nt, artificial
  Chemically synthesized
uucuuucuguguuucacau

SEQ ID NO: 813 - RNA, 19 nt, artificial
  Chemically synthesized
caaauguagucucuuuucu

SEQ ID NO: 814 - RNA, 19 nt, artificial
  Chemically synthesized
aaaccccaaauguagucuc

SEQ ID NO: 815 - RNA, 19 nt, artificial
  Chemically synthesized
ugcccuaaauaagaaaccc

SEQ ID NO: 816 - RNA, 19 nt, artificial
  Chemically synthesized
aaacuauucagcuagucag

SEQ ID NO: 817 - RNA, 19 nt, artificial
  Chemically synthesized
gugauugaaggguccuaaa

SEQ ID NO: 818 - RNA, 19 nt, artificial
  Chemically synthesized
ucaggauuucgacuuguua

SEQ ID NO: 819 - RNA, 19 nt, artificial
  Chemically synthesized
uagaggucgcuucuccucu

SEQ ID NO: 820 - RNA, 19 nt, artificial
  Chemically synthesized
aacugcucauggacuagcu

SEQ ID NO: 821 - RNA, 19 nt, artificial
  Chemically synthesized
ggugauggcuuauggaagg

SEQ ID NO: 822 - RNA, 19 nt, artificial
  Chemically synthesized
aggcuucuugggcaucgau

SEQ ID NO: 823 - RNA, 19 nt, artificial
  Chemically synthesized
uaagcuccaaagguucacu

SEQ ID NO: 824 - RNA, 19 nt, artificial
  Chemically synthesized
ggccaagauaaaucaaugu

SEQ ID NO: 825 - RNA, 19 nt, artificial
  Chemically synthesized
uucaaaugcuuggaaagau

SEQ ID NO: 826 - RNA, 19 nt, artificial
  Chemically synthesized
gggacagauguauucaucc

SEQ ID NO: 827 - RNA, 19 nt, artificial
  Chemically synthesized
agcuuauucagguuuccug

SEQ ID NO: 828 - RNA, 19 nt, artificial
  Chemically synthesized
auuccaacuaaguagauca

SEQ ID NO: 829 - RNA, 19 nt, artificial
  Chemically synthesized
aguacagccuagagaauga

SEQ ID NO: 830 - RNA, 19 nt, artificial
  Chemically synthesized
auaguacagccuagagaau

SEQ ID NO: 831 - RNA, 19 nt, artificial
  Chemically synthesized
gguuuauaguacagccuag

SEQ ID NO: 832 - RNA, 19 nt, artificial
  Chemically synthesized
gauaugguuuauaguacag

SEQ ID NO: 833 - RNA, 19 nt, artificial
  Chemically synthesized
ggagauaugguuuauagua

SEQ ID NO: 834 - RNA, 19 nt, artificial
  Chemically synthesized
aaccccaauugucaagggu

SEQ ID NO: 835 - RNA, 19 nt, artificial
  Chemically synthesized
uaucucuccuuaaccccaa

SEQ ID NO: 836 - RNA, 19 nt, artificial
  Chemically synthesized
guaucucuccuuaacccca

SEQ ID NO: 837 - RNA, 19 nt, artificial
  Chemically synthesized
ucugggcuuuucugggaau

SEQ ID NO: 838 - RNA, 19 nt, artificial
  Chemically synthesized
gaaccauuucaccauggca

SEQ ID NO: 839 - RNA, 19 nt, artificial
  Chemically synthesized
ucuauccucuuuucaguau

SEQ ID NO: 840 - RNA, 19 nt, artificial
  Chemically synthesized
uguguguaguugauuacuc

SEQ ID NO: 841 - RNA, 19 nt, artificial
  Chemically synthesized
cuuaaguguugaauacugu

SEQ ID NO: 842 - RNA, 19 nt, artificial
  Chemically synthesized
ucuuaaguguugaauacug

SEQ ID NO: 843 - RNA, 19 nt, artificial
  Chemically synthesized
aaaccagauuugccuauuu

SEQ ID NO: 844 - RNA, 19 nt, artificial
  Chemically synthesized
ccuuuggagaagugauuca

SEQ ID NO: 845 - RNA, 19 nt, artificial
  Chemically synthesized
uggccuuuggagaagugau

SEQ ID NO: 846 - RNA, 19 nt, artificial
  Chemically synthesized
uguagucucuuuucuuucu

SEQ ID NO: 847 - RNA, 19 nt, artificial
  Chemically synthesized
cuaaauaagaaaccccaaa

SEQ ID NO: 848 - RNA, 19 nt, artificial
  Chemically synthesized
ccugcccuaaauaagaaac

SEQ ID NO: 849 - RNA, 19 nt, artificial
  Chemically synthesized
aaacuuuacucacugauug

SEQ ID NO: 850 - RNA, 19 nt, artificial
  Chemically synthesized
gaaaaaacuuuacucacug

SEQ ID NO: 851 - RNA, 19 nt, artificial
  Chemically synthesized
ggauuucgacuuguuaaga

SEQ ID NO: 852 - RNA, 19 nt, artificial
  Chemically synthesized
caggauuucgacuuguuaa

SEQ ID NO: 853 - RNA, 19 nt, artificial
  Chemically synthesized
cuggcaguuugagcagcaa

SEQ ID NO: 854 - RNA, 19 nt, artificial
  Chemically synthesized
acuggcaguuugagcagca

SEQ ID NO: 855 - RNA, 19 nt, artificial
  Chemically synthesized
uaggauugugugugauucu

SEQ ID NO: 856 - RNA, 19 nt, artificial
  Chemically synthesized
cuggauaggauugugugug

SEQ ID NO: 857 - RNA, 19 nt, artificial
  Chemically synthesized
caaagguccuugucccuga

SEQ ID NO: 858 - RNA, 19 nt, artificial
  Chemically synthesized
guugcucaaagguccuugu

SEQ ID NO: 859 - RNA, 19 nt, artificial
  Chemically synthesized
aaacuugguugcucaaagg

SEQ ID NO: 860 - RNA, 19 nt, artificial
  Chemically synthesized
uggugauggcuuauggaag

SEQ ID NO: 861 - RNA, 19 nt, artificial
  Chemically synthesized
ggaguugucaccacugacu

SEQ ID NO: 862 - RNA, 19 nt, artificial
  Chemically synthesized
acaauguucaauucagcaa

SEQ ID NO: 863 - RNA, 19 nt, artificial
  Chemically synthesized
ugaggaaucaacuugccag

SEQ ID NO: 864 - RNA, 19 nt, artificial
  Chemically synthesized
uggagauaugguuuauagu

SEQ ID NO: 865 - RNA, 19 nt, artificial
  Chemically synthesized
cuauggagauaugguuuau

SEQ ID NO: 866 - RNA, 19 nt, artificial
  Chemically synthesized
ccccaauugucaaggguag

SEQ ID NO: 867 - RNA, 19 nt, artificial
  Chemically synthesized
uaaccccaauugucaaggg

SEQ ID NO: 868 - RNA, 19 nt, artificial
  Chemically synthesized
acuuaguaaucuauccucu

SEQ ID NO: 869 - RNA, 19 nt, artificial
  Chemically synthesized
cacuuaguaaucuauccuc

SEQ ID NO: 870 - RNA, 19 nt, artificial
  Chemically synthesized
aggaaauuaguucugagau

SEQ ID NO: 871 - RNA, 19 nt, artificial
  Chemically synthesized
uggugacuuccucacucua

SEQ ID NO: 872 - RNA, 19 nt, artificial
  Chemically synthesized
guuucagguaggcuuggua

SEQ ID NO: 873 - RNA, 19 nt, artificial
  Chemically synthesized
auagguaagcaaaaguaga

SEQ ID NO: 874 - RNA, 19 nt, artificial
  Chemically synthesized
acaacagugauugaagggu

SEQ ID NO: 875 - RNA, 19 nt, artificial
  Chemically synthesized
gaacugcucauggacuagc

SEQ ID NO: 876 - RNA, 19 nt, artificial
  Chemically synthesized
guguuuaagcaggagaacu

SEQ ID NO: 877 - RNA, 19 nt, artificial
  Chemically synthesized
gagaaacugacccagagaa

SEQ ID NO: 878 - RNA, 19 nt, artificial
  Chemically synthesized
caauguucaauucagcaag

SEQ ID NO: 879 - RNA, 19 nt, artificial
  Chemically synthesized
ggcuauggagauaugguuu

SEQ ID NO: 880 - RNA, 19 nt, artificial
  Chemically synthesized
auaggaaauuaguucugag

SEQ ID NO: 881 - RNA, 19 nt, artificial
  Chemically synthesized
gauaggaaauuaguucuga

SEQ ID NO: 882 - RNA, 19 nt, artificial
  Chemically synthesized
auaaaccagauuugccuau

SEQ ID NO: 883 - RNA, 19 nt, artificial
  Chemically synthesized
caacagugauugaaggguc

SEQ ID NO: 884 - RNA, 19 nt, artificial
  Chemically synthesized
ugguugcucaaagguccuu

SEQ ID NO: 885 - RNA, 19 nt, artificial
  Chemically synthesized
uugguugcucaaagguccu

SEQ ID NO: 886 - RNA, 19 nt, artificial
  Chemically synthesized
augcuuacaaaauggugau

SEQ ID NO: 887 - RNA, 19 nt, artificial
  Chemically synthesized
cuggaguugucaccacuga

SEQ ID NO: 888 - RNA, 19 nt, artificial
  Chemically synthesized
cuccaaagguucacugugu

SEQ ID NO: 889 - RNA, 19 nt, artificial
  Chemically synthesized
gagguaauauuugaggaau

SEQ ID NO: 890 - RNA, 19 nt, artificial
  Chemically synthesized
acgagguaauauuugagga

SEQ ID NO: 891 - RNA, 19 nt, artificial
  Chemically synthesized
guuccugacucaaauuuga

SEQ ID NO: 892 - RNA, 19 nt, artificial
  Chemically synthesized
cugauccucagcucaggau

SEQ ID NO: 893 - RNA, 19 nt, artificial
  Chemically synthesized
agguaauauuugaggaauc

SEQ ID NO: 894 - RNA, 19 nt, artificial
  Chemically synthesized
cgagguaauauuugaggaa

SEQ ID NO: 895 - RNA, 19 nt, artificial
  Chemically synthesized
aucaaaacuuccaaaagcc

SEQ ID NO: 896 - RNA, 19 nt, artificial
  Chemically synthesized
uaucaaaacuuccaaaagc

SEQ ID NO: 897 - RNA, 19 nt, artificial
  Chemically synthesized
cugauuuucuggccuuugg

SEQ ID NO: 898 - RNA, 19 nt, artificial
  Chemically synthesized
cacuuguguuuaagcagga

SEQ ID NO: 899 - RNA, 19 nt, artificial
  Chemically synthesized
uaugcuuacaaaaugguga

SEQ ID NO: 900 - RNA, 19 nt, artificial
  Chemically synthesized
gaauugaaguaucucuccu

SEQ ID NO: 901 - RNA, 19 nt, artificial
  Chemically synthesized
uuccugacucaaauuugaa

SEQ ID NO: 902 - RNA, 19 nt, artificial
  Chemically synthesized
uucucuaaguuuucagagg

SEQ ID NO: 903 - RNA, 19 nt, artificial
  Chemically synthesized
ugaaugggauggaauaggu

SEQ ID NO: 904 - RNA, 19 nt, artificial
  Chemically synthesized
gaagugauucaaaauagug

SEQ ID NO: 905 - RNA, 19 nt, artificial
  Chemically synthesized
uugaaggguccuaaaaagg

SEQ ID NO: 906 - RNA, 19 nt, artificial
  Chemically synthesized
cgacuuguuaagaaaaaac

SEQ ID NO: 907 - RNA, 19 nt, artificial
  Chemically synthesized
uuguguuuaagcaggagaa

SEQ ID NO: 908 - RNA, 19 nt, artificial
  Chemically synthesized
acacuuguguuuaagcagg

SEQ ID NO: 909 - RNA, 19 nt, artificial
  Chemically synthesized
uuacacuuguguuuaagca

SEQ ID NO: 910 - RNA, 19 nt, artificial
  Chemically synthesized
agaaacugacccagagaau

SEQ ID NO: 911 - RNA, 19 nt, artificial
  Chemically synthesized
ccauggcaguguuaucuca

SEQ ID NO: 912 - RNA, 19 nt, artificial
  Chemically synthesized
auugaaggguccuaaaaag

SEQ ID NO: 913 - RNA, 19 nt, artificial
  Chemically synthesized
uggaacaacagugauugaa

SEQ ID NO: 914 - RNA, 19 nt, artificial
  Chemically synthesized
gcaacuggcaguuugagca

SEQ ID NO: 915 - RNA, 19 nt, artificial
  Chemically synthesized
gguaauauuugaggaauca

SEQ ID NO: 916 - RNA, 19 nt, artificial
  Chemically synthesized
cugagaaacugacccagag

SEQ ID NO: 917 - RNA, 19 nt, artificial
  Chemically synthesized
cucugggcuuuucugggaa

SEQ ID NO: 918 - RNA, 19 nt, artificial
  Chemically synthesized
uuggaacaacagugauuga

SEQ ID NO: 919 - RNA, 19 nt, artificial
  Chemically synthesized
ugauggcuuauggaaggcu

SEQ ID NO: 920 - RNA, 19 nt, artificial
  Chemically synthesized
gugauggcuuauggaaggc

SEQ ID NO: 921 - RNA, 19 nt, artificial
  Chemically synthesized
uuggcuauggagauauggu

SEQ ID NO: 922 - RNA, 19 nt, artificial
  Chemically synthesized
cucuuuucuuucuguguuu

SEQ ID NO: 923 - RNA, 19 nt, artificial
  Chemically synthesized
ggaacaacagugauugaag

SEQ ID NO: 924 - RNA, 19 nt, artificial
  Chemically synthesized
ucucugggcuuuucuggga

SEQ ID NO: 925 - RNA, 19 nt, artificial
  Chemically synthesized
ucucuuuucuuucuguguu

SEQ ID NO: 926 - RNA, 19 nt, artificial
  Chemically synthesized
gucucuuuucuuucugugu

SEQ ID NO: 927 - RNA, 19 nt, artificial
  Chemically synthesized
aguuuguuagaacacuggc

SEQ ID NO: 928 - RNA, 19 nt, artificial
  Chemically synthesized
uuuguuagaacacuggcua

SEQ ID NO: 929 - RNA, 19 nt, artificial
  Chemically synthesized
auuagagugaggaagucac

SEQ ID NO: 930 - RNA, 19 nt, artificial
  Chemically synthesized
guuuguuagaacacuggcu

SEQ ID NO: 931 - RNA, 19 nt, artificial
  Chemically synthesized
agguauucaucauucacuc

SEQ ID NO: 932 - RNA, 19 nt, artificial
  Chemically synthesized
acauuagagugaggaaguc

SEQ ID NO: 933 - RNA, 19 nt, artificial
  Chemically synthesized
gaguuuaguuuguuagaac

SEQ ID NO: 934 - RNA, 19 nt, artificial
  Chemically synthesized
ucacagguauucaucauuc

SEQ ID NO: 935 - RNA, 19 nt, artificial
  Chemically synthesized
uaaaacauuagagugagga

SEQ ID NO: 936 - RNA, 19 nt, artificial
  Chemically synthesized
auuuuaaccaaauucuggc

SEQ ID NO: 937 - RNA, 19 nt, artificial
  Chemically synthesized
acuucguaaauugacccgu

SEQ ID NO: 938 - RNA, 19 nt, artificial
  Chemically synthesized
ucaucauucacucaaugga

SEQ ID NO: 939 - RNA, 19 nt, artificial
  Chemically synthesized
aaaacauuagagugaggaa

SEQ ID NO: 940 - RNA, 19 nt, artificial
  Chemically synthesized
guggaaaaaaucugggugc

SEQ ID NO: 941 - RNA, 19 nt, artificial
  Chemically synthesized
guuacugaaauggcaccac

SEQ ID NO: 942 - RNA, 19 nt, artificial
  Chemically synthesized
uuaaaacauuagagugagg

SEQ ID NO: 943 - RNA, 19 nt, artificial
  Chemically synthesized
aaacauuagagugaggaag

SEQ ID NO: 944 - RNA, 19 nt, artificial
  Chemically synthesized
acuuagagaaaaaaaagcc

SEQ ID NO: 945 - RNA, 19 nt, artificial
  Chemically synthesized
auucuguacaaaaauggga

SEQ ID NO: 946 - RNA, 19 nt, artificial
  Chemically synthesized
cuauuuugaaucacuucuc

SEQ ID NO: 947 - RNA, 19 nt, artificial
  Chemically synthesized
uauuuugaaucacuucucc

SEQ ID NO: 948 - RNA, 19 nt, artificial
  Chemically synthesized
acaaaugacuuuagcugac

SEQ ID NO: 949 - RNA, 19 nt, artificial
  Chemically synthesized
auucugaaaugcuggccgg

SEQ ID NO: 950 - RNA, 19 nt, artificial
  Chemically synthesized
acagacaguucuccagcau

SEQ ID NO: 951 - RNA, 19 nt, artificial
  Chemically synthesized
agacaguucuccagcauuu

SEQ ID NO: 952 - RNA, 19 nt, artificial
  Chemically synthesized
uucuccagcauuuuaacca

SEQ ID NO: 953 - RNA, 19 nt, artificial
  Chemically synthesized
ucuccagcauuuuaaccaa

SEQ ID NO: 954 - RNA, 19 nt, artificial
  Chemically synthesized
agcaugugaaguggagcua

SEQ ID NO: 955 - RNA, 19 nt, artificial
  Chemically synthesized
acauuguugaguggaggcu

SEQ ID NO: 956 - RNA, 19 nt, artificial
  Chemically synthesized
agguggaaaaaaucugggu

SEQ ID NO: 957 - RNA, 19 nt, artificial
  Chemically synthesized
uggaaaaaaucugggugca

SEQ ID NO: 958 - RNA, 19 nt, artificial
  Chemically synthesized
uucguaaauugacccguuu

SEQ ID NO: 959 - RNA, 19 nt, artificial
  Chemically synthesized
ccucacagguauucaucau

SEQ ID NO: 960 - RNA, 19 nt, artificial
  Chemically synthesized
guauucaucauucacucaa

SEQ ID NO: 961 - RNA, 19 nt, artificial
  Chemically synthesized
agcaguuccauuauugccg

SEQ ID NO: 962 - RNA, 19 nt, artificial
  Chemically synthesized
uuuggaaguuuugauaggc

SEQ ID NO: 963 - RNA, 19 nt, artificial
  Chemically synthesized
cuuagagaaaaaaaagcca

SEQ ID NO: 964 - RNA, 19 nt, artificial
  Chemically synthesized
auguaaaacucaaaugggc

SEQ ID NO: 965 - RNA, 19 nt, artificial
  Chemically synthesized
caauucugaaaugcuggcc

SEQ ID NO: 966 - RNA, 19 nt, artificial
  Chemically synthesized
aauucugaaaugcuggccg

SEQ ID NO: 967 - RNA, 19 nt, artificial
  Chemically synthesized
ucaaaaguagguacgacgc

SEQ ID NO: 968 - RNA, 19 nt, artificial
  Chemically synthesized
aaaaguagguacgacgcua

SEQ ID NO: 969 - RNA, 19 nt, artificial
  Chemically synthesized
uuuccaaguucacgugcau

SEQ ID NO: 970 - RNA, 19 nt, artificial
  Chemically synthesized
guuaguggaaaaaggacaa

SEQ ID NO: 971 - RNA, 19 nt, artificial
  Chemically synthesized
uuaguggaaaaaggacaac

SEQ ID NO: 972 - RNA, 19 nt, artificial
  Chemically synthesized
aguggaaaaaggacaacag

SEQ ID NO: 973 - RNA, 19 nt, artificial
  Chemically synthesized
uggacagacaguucuccag

SEQ ID NO: 974 - RNA, 19 nt, artificial
  Chemically synthesized
caauucuauaaagauuggc

SEQ ID NO: 975 - RNA, 19 nt, artificial
  Chemically synthesized
aacacuggcuaauuugaac

SEQ ID NO: 976 - RNA, 19 nt, artificial
  Chemically synthesized
uuuuaaccaaauucuggca

SEQ ID NO: 977 - RNA, 19 nt, artificial
  Chemically synthesized
aagguggaaaaaaucuggg

SEQ ID NO: 978 - RNA, 19 nt, artificial
  Chemically synthesized
gguggaaaaaaucugggug

SEQ ID NO: 979 - RNA, 19 nt, artificial
  Chemically synthesized
augcagacuucguaaauug

SEQ ID NO: 980 - RNA, 19 nt, artificial
  Chemically synthesized
agacuucguaaauugaccc

SEQ ID NO: 981 - RNA, 19 nt, artificial
  Chemically synthesized
cuucguaaauugacccguu

SEQ ID NO: 982 - RNA, 19 nt, artificial
  Chemically synthesized
cguaaauugacccguuuca

SEQ ID NO: 983 - RNA, 19 nt, artificial
  Chemically synthesized
gguuacugaaauggcacca

SEQ ID NO: 984 - RNA, 19 nt, artificial
  Chemically synthesized
aaacagugaagcaguucca

SEQ ID NO: 985 - RNA, 19 nt, artificial
  Chemically synthesized
accuacuuaauccuaccuu

SEQ ID NO: 986 - RNA, 19 nt, artificial
  Chemically synthesized
acuuaauccuaccuuccug

SEQ ID NO: 987 - RNA, 19 nt, artificial
  Chemically synthesized
uuggaaguuuugauaggcu

SEQ ID NO: 988 - RNA, 19 nt, artificial
  Chemically synthesized
aaaauaggcaaaucugguu

SEQ ID NO: 989 - RNA, 19 nt, artificial
  Chemically synthesized
aucccauucaauucuguac

SEQ ID NO: 990 - RNA, 19 nt, artificial
  Chemically synthesized
uucuguacaaaaaugggau

SEQ ID NO: 991 - RNA, 19 nt, artificial
  Chemically synthesized
cuacaaaugacuuuagcug

SEQ ID NO: 992 - RNA, 19 nt, artificial
  Chemically synthesized
aguuuuacuacccaaucau

SEQ ID NO: 993 - RNA, 19 nt, artificial
  Chemically synthesized
uuucccuuuuuaggacccu

SEQ ID NO: 994 - RNA, 19 nt, artificial
  Chemically synthesized
ucaauuuccaaguucacgu

SEQ ID NO: 995 - RNA, 19 nt, artificial
  Chemically synthesized
aggacaucuugagcaauuc

SEQ ID NO: 996 - RNA, 19 nt, artificial
  Chemically synthesized
gacaucuugagcaauucuc

SEQ ID NO: 997 - RNA, 19 nt, artificial
  Chemically synthesized
acaucuugagcaauucucu

SEQ ID NO: 998 - RNA, 19 nt, artificial
  Chemically synthesized
aucuugagcaauucucugg

SEQ ID NO: 999 - RNA, 19 nt, artificial
  Chemically synthesized
ucuugagcaauucucuggg

SEQ ID NO: 1000 - RNA, 19 nt, artificial
  Chemically synthesized
uugauuuggacagacaguu

SEQ ID NO: 1001 - RNA, 19 nt, artificial
  Chemically synthesized
uguuaguggaaaaaggaca

SEQ ID NO: 1002 - RNA, 19 nt, artificial
  Chemically synthesized
ggaaaaaggacaacaguuc

SEQ ID NO: 1003 - RNA, 19 nt, artificial
  Chemically synthesized
uuuggacagacaguucucc

SEQ ID NO: 1004 - RNA, 19 nt, artificial
  Chemically synthesized
uuaguuuguuagaacacug

SEQ ID NO: 1005 - RNA, 19 nt, artificial
  Chemically synthesized
uuagaacacuggcuaauuu

SEQ ID NO: 1006 - RNA, 19 nt, artificial
  Chemically synthesized
aacagugacauuuuagguc

SEQ ID NO: 1007 - RNA, 19 nt, artificial
  Chemically synthesized
uuuaaccaaauucuggcaa

SEQ ID NO: 1008 - RNA, 19 nt, artificial
  Chemically synthesized
ugaauaagcuccuuaucca

SEQ ID NO: 1009 - RNA, 19 nt, artificial
  Chemically synthesized
aggauaugaaagccuugcu

SEQ ID NO: 1010 - RNA, 19 nt, artificial
  Chemically synthesized
ugaacauuguugaguggag

SEQ ID NO: 1011 - RNA, 19 nt, artificial
  Chemically synthesized
auuguugaguggaggcuaa

SEQ ID NO: 1012 - RNA, 19 nt, artificial
  Chemically synthesized
aguggaggcuaaauucucu

SEQ ID NO: 1013 - RNA, 19 nt, artificial
  Chemically synthesized
aggaaagagauaaugaucu

SEQ ID NO: 1014 - RNA, 19 nt, artificial
  Chemically synthesized
uaagacaaaaaauaaggcc

SEQ ID NO: 1015 - RNA, 19 nt, artificial
  Chemically synthesized
ccaagguggaaaaaaucug

SEQ ID NO: 1016 - RNA, 19 nt, artificial
  Chemically synthesized
caagguggaaaaaaucugg

SEQ ID NO: 1017 - RNA, 19 nt, artificial
  Chemically synthesized
ugaguuucauucucuaggc

SEQ ID NO: 1018 - RNA, 19 nt, artificial
  Chemically synthesized
agccaaugcagacuucgua

SEQ ID NO: 1019 - RNA, 19 nt, artificial
  Chemically synthesized
gacuucguaaauugacccg

SEQ ID NO: 1020 - RNA, 19 nt, artificial
  Chemically synthesized
ucguaaauugacccguuuc

SEQ ID NO: 1021 - RNA, 19 nt, artificial
  Chemically synthesized
aagugaaucagagagggac

SEQ ID NO: 1022 - RNA, 19 nt, artificial
  Chemically synthesized
uucuuaggaguccccucuc

SEQ ID NO: 1023 - RNA, 19 nt, artificial
  Chemically synthesized
ccuacuuaauccuaccuuc

SEQ ID NO: 1024 - RNA, 19 nt, artificial
  Chemically synthesized
uggaaguuuugauaggcua

SEQ ID NO: 1025 - RNA, 19 nt, artificial
  Chemically synthesized
caauucuguacaaaaaugg

SEQ ID NO: 1026 - RNA, 19 nt, artificial
  Chemically synthesized
uguacaaaaaugggaucua

SEQ ID NO: 1027 - RNA, 19 nt, artificial
  Chemically synthesized
aaaucagccuguuagcugc

SEQ ID NO: 1028 - RNA, 19 nt, artificial
  Chemically synthesized
ugcuaugaaugugaaacac

SEQ ID NO: 1029 - RNA, 19 nt, artificial
  Chemically synthesized
uauuuucccuuuuuaggac

SEQ ID NO: 1030 - RNA, 19 nt, artificial
  Chemically synthesized
uuuucccuuuuuaggaccc

SEQ ID NO: 1031 - RNA, 19 nt, artificial
  Chemically synthesized
uucccuuuuuaggacccuu

SEQ ID NO: 1032 - RNA, 19 nt, artificial
  Chemically synthesized
acuaaagaaaaagucccug

SEQ ID NO: 1033 - RNA, 19 nt, artificial
  Chemically synthesized
auuuccaaguucacgugca

SEQ ID NO: 1034 - RNA, 19 nt, artificial
  Chemically synthesized
aaguucacgugcauaacac

SEQ ID NO: 1035 - RNA, 19 nt, artificial
  Chemically synthesized
uucacgugcauaacacaac

SEQ ID NO: 1036 - RNA, 19 nt, artificial
  Chemically synthesized
acgugcauaacacaaccuc

SEQ ID NO: 1037 - RNA, 19 nt, artificial
  Chemically synthesized
uugagcaauucucuggguc

SEQ ID NO: 1038 - RNA, 19 nt, artificial
  Chemically synthesized
aaccaaguuuaguuugcuu

SEQ ID NO: 1039 - RNA, 19 nt, artificial
  Chemically synthesized
uuaguuugcuuugauuugg

SEQ ID NO: 1040 - RNA, 19 nt, artificial
  Chemically synthesized
auuaauuuaacagccuucc

SEQ ID NO: 1041 - RNA, 19 nt, artificial
  Chemically synthesized
uuuguaagcauaacaggca

SEQ ID NO: 1042 - RNA, 19 nt, artificial
  Chemically synthesized
uuguaagcauaacaggcaa

SEQ ID NO: 1043 - RNA, 19 nt, artificial
  Chemically synthesized
auaacaggcaagagaguca

SEQ ID NO: 1044 - RNA, 19 nt, artificial
  Chemically synthesized
cuguuaguggaaaaaggac

SEQ ID NO: 1045 - RNA, 19 nt, artificial
  Chemically synthesized
aaaaaggacaacaguucua

SEQ ID NO: 1046 - RNA, 19 nt, artificial
  Chemically synthesized
aaaaggacaacaguucuac

SEQ ID NO: 1047 - RNA, 19 nt, artificial
  Chemically synthesized
auuuggacagacaguucuc

SEQ ID NO: 1048 - RNA, 19 nt, artificial
  Chemically synthesized
aacauugauuuaucuuggc

SEQ ID NO: 1049 - RNA, 19 nt, artificial
  Chemically synthesized
cuauaaagauuggcuuugu

SEQ ID NO: 1050 - RNA, 19 nt, artificial
  Chemically synthesized
cuaauuugaacagugacau

SEQ ID NO: 1051 - RNA, 19 nt, artificial
  Chemically synthesized
guaucaguaacaggaucac

SEQ ID NO: 1052 - RNA, 19 nt, artificial
  Chemically synthesized
cagcauuuuaaccaaauuc

SEQ ID NO: 1053 - RNA, 19 nt, artificial
  Chemically synthesized
agcaaggauaugaaagccu

SEQ ID NO: 1054 - RNA, 19 nt, artificial
  Chemically synthesized
ggauaugaaagccuugcug

SEQ ID NO: 1055 - RNA, 19 nt, artificial
  Chemically synthesized
aacauuguugaguggaggc

SEQ ID NO: 1056 - RNA, 19 nt, artificial
  Chemically synthesized
uugaguggaggcuaaauuc

SEQ ID NO: 1057 - RNA, 19 nt, artificial
  Chemically synthesized
guggaggcuaaauucucuc

SEQ ID NO: 1058 - RNA, 19 nt, artificial
  Chemically synthesized
ggaaagagauaaugaucua

SEQ ID NO: 1059 - RNA, 19 nt, artificial
  Chemically synthesized
aagacaaaaaauaaggccu

SEQ ID NO: 1060 - RNA, 19 nt, artificial
  Chemically synthesized
agacaaaaaauaaggccuu

SEQ ID NO: 1061 - RNA, 19 nt, artificial
  Chemically synthesized
aaaaaaucugggugcaugc

SEQ ID NO: 1062 - RNA, 19 nt, artificial
  Chemically synthesized
cagacuucguaaauugacc

SEQ ID NO: 1063 - RNA, 19 nt, artificial
  Chemically synthesized
ucaauucccagaaaagccc

SEQ ID NO: 1064 - RNA, 19 nt, artificial
  Chemically synthesized
uuccuauccucacagguau

SEQ ID NO: 1065 - RNA, 19 nt, artificial
  Chemically synthesized
auucacucaauggaagagu

SEQ ID NO: 1066 - RNA, 19 nt, artificial
  Chemically synthesized
ucaggaacaacauaauccc

SEQ ID NO: 1067 - RNA, 19 nt, artificial
  Chemically synthesized
cgugguuacugaaauggca

SEQ ID NO: 1068 - RNA, 19 nt, artificial
  Chemically synthesized
uuacugaaauggcaccaca

SEQ ID NO: 1069 - RNA, 19 nt, artificial
  Chemically synthesized
ugaaauggcaccacaagcu

SEQ ID NO: 1070 - RNA, 19 nt, artificial
  Chemically synthesized
ccucuuuaaaacauuagag

SEQ ID NO: 1071 - RNA, 19 nt, artificial
  Chemically synthesized
agaaacagugaagcaguuc

SEQ ID NO: 1072 - RNA, 19 nt, artificial
  Chemically synthesized
gaaacagugaagcaguucc

SEQ ID NO: 1073 - RNA, 19 nt, artificial
  Chemically synthesized
gcaguuccauuauugccgu

SEQ ID NO: 1074 - RNA, 19 nt, artificial
  Chemically synthesized
auuuacucuuaccuagggu

SEQ ID NO: 1075 - RNA, 19 nt, artificial
  Chemically synthesized
auccucugaaaacuuagag

SEQ ID NO: 1076 - RNA, 19 nt, artificial
  Chemically synthesized
auauagucuauuaccaagc

SEQ ID NO: 1077 - RNA, 19 nt, artificial
  Chemically synthesized
auagucuauuaccaagccu

SEQ ID NO: 1078 - RNA, 19 nt, artificial
  Chemically synthesized
ggaaucaaauguaaaacuc

SEQ ID NO: 1079 - RNA, 19 nt, artificial
  Chemically synthesized
uaaaacucaaaugggcuuc

SEQ ID NO: 1080 - RNA, 19 nt, artificial
  Chemically synthesized
aaaaucacuuagcaggcuc

SEQ ID NO: 1081 - RNA, 19 nt, artificial
  Chemically synthesized
ucccauucaauucuguaca

SEQ ID NO: 1082 - RNA, 19 nt, artificial
  Chemically synthesized
cccauucaauucuguacaa

SEQ ID NO: 1083 - RNA, 19 nt, artificial
  Chemically synthesized
cuacacuauuuugaaucac

SEQ ID NO: 1084 - RNA, 19 nt, artificial
  Chemically synthesized
uuuugaaucacuucuccaa

SEQ ID NO: 1085 - RNA, 19 nt, artificial
  Chemically synthesized
aggccagaaaaucagccug

SEQ ID NO: 1086 - RNA, 19 nt, artificial
  Chemically synthesized
agaaaaucagccuguuagc

SEQ ID NO: 1087 - RNA, 19 nt, artificial
  Chemically synthesized
aacuacaaaugacuuuagc

SEQ ID NO: 1088 - RNA, 19 nt, artificial
  Chemically synthesized
aaaugacuuuagcugacua

SEQ ID NO: 1089 - RNA, 19 nt, artificial
  Chemically synthesized
aaugacuuuagcugacuag

SEQ ID NO: 1090 - RNA, 19 nt, artificial
  Chemically synthesized
uaguuuuacuacccaauca

SEQ ID NO: 1091 - RNA, 19 nt, artificial
  Chemically synthesized
uccagcaauucugaaaugc

SEQ ID NO: 1092 - RNA, 19 nt, artificial
  Chemically synthesized
ucccuuuuuaggacccuuc

SEQ ID NO: 1093 - RNA, 19 nt, artificial
  Chemically synthesized
ucagaguucuccugaaacc

SEQ ID NO: 1094 - RNA, 19 nt, artificial
  Chemically synthesized
uucuccugaaaccagagga

SEQ ID NO: 1095 - RNA, 19 nt, artificial
  Chemically synthesized
uacuaaagaaaaagucccu

SEQ ID NO: 1096 - RNA, 19 nt, artificial
  Chemically synthesized
aguguaagcucaaaaguag

SEQ ID NO: 1097 - RNA, 19 nt, artificial
  Chemically synthesized
aaaguagguacgacgcuag

SEQ ID NO: 1098 - RNA, 19 nt, artificial
  Chemically synthesized
auccuauccagcuuuuuac

SEQ ID NO: 1099 - RNA, 19 nt, artificial
  Chemically synthesized
uccaaguucacgugcauaa

SEQ ID NO: 1100 - RNA, 19 nt, artificial
  Chemically synthesized
ucacgugcauaacacaacc

SEQ ID NO: 1101 - RNA, 19 nt, artificial
  Chemically synthesized
gugcauaacacaaccucgc

SEQ ID NO: 1102 - RNA, 19 nt, artificial
  Chemically synthesized
accaaguuuaguuugcuuu

SEQ ID NO: 1103 - RNA, 19 nt, artificial
  Chemically synthesized
cauuuuguaagcauaacag

SEQ ID NO: 1104 - RNA, 19 nt, artificial
  Chemically synthesized
acuguuaguggaaaaagga

SEQ ID NO: 1105 - RNA, 19 nt, artificial
  Chemically synthesized
cccaauucuauaaagauug

SEQ ID NO: 1106 - RNA, 19 nt, artificial
  Chemically synthesized
ccaauucuauaaagauugg

SEQ ID NO: 1107 - RNA, 19 nt, artificial
  Chemically synthesized
aagauuggcuuuguaguau

SEQ ID NO: 1108 - RNA, 19 nt, artificial
  Chemically synthesized
uaguuuguuagaacacugg

SEQ ID NO: 1109 - RNA, 19 nt, artificial
  Chemically synthesized
acuggcuaauuugaacagu

SEQ ID NO: 1110 - RNA, 19 nt, artificial
  Chemically synthesized
ugaacagugacauuuuagg

SEQ ID NO: 1111 - RNA, 19 nt, artificial
  Chemically synthesized
acagugacauuuuagguca

SEQ ID NO: 1112 - RNA, 19 nt, artificial
  Chemically synthesized
ugacauuuuaggucacuua

SEQ ID NO: 1113 - RNA, 19 nt, artificial
  Chemically synthesized
cauuuuaggucacuuauag

SEQ ID NO: 1114 - RNA, 19 nt, artificial
  Chemically synthesized
aucaguaacaggaucacac

SEQ ID NO: 1115 - RNA, 19 nt, artificial
  Chemically synthesized
ucuccagcaugugaagugg

SEQ ID NO: 1116 - RNA, 19 nt, artificial
  Chemically synthesized
cagcaaggauaugaaagcc

SEQ ID NO: 1117 - RNA, 19 nt, artificial
  Chemically synthesized
aaggauaugaaagccuugc

SEQ ID NO: 1118 - RNA, 19 nt, artificial
  Chemically synthesized
aauugaacauuguugagug

SEQ ID NO: 1119 - RNA, 19 nt, artificial
  Chemically synthesized
cauuguugaguggaggcua

SEQ ID NO: 1120 - RNA, 19 nt, artificial
  Chemically synthesized
gaaagagauaaugaucuac

SEQ ID NO: 1121 - RNA, 19 nt, artificial
  Chemically synthesized
ugacagguauccaaggugg

SEQ ID NO: 1122 - RNA, 19 nt, artificial
  Chemically synthesized
aaaaucugggugcaugcau

SEQ ID NO: 1123 - RNA, 19 nt, artificial
  Chemically synthesized
guaaauugacccguuucaa

SEQ ID NO: 1124 - RNA, 19 nt, artificial
  Chemically synthesized
ucaaauauuaccucguuga

SEQ ID NO: 1125 - RNA, 19 nt, artificial
  Chemically synthesized
aauauuaccucguugaggu

SEQ ID NO: 1126 - RNA, 19 nt, artificial
  Chemically synthesized
auuaccucguugagguugg

SEQ ID NO: 1127 - RNA, 19 nt, artificial
  Chemically synthesized
uucaucugagauuaagcac

SEQ ID NO: 1128 - RNA, 19 nt, artificial
  Chemically synthesized
ugaaucagagagggacuag

SEQ ID NO: 1129 - RNA, 19 nt, artificial
  Chemically synthesized
uauccucacagguauucau

SEQ ID NO: 1130 - RNA, 19 nt, artificial
  Chemically synthesized
cuucuuaggaguccccucu

SEQ ID NO: 1131 - RNA, 19 nt, artificial
  Chemically synthesized
acucaauggaagaguaauc

SEQ ID NO: 1132 - RNA, 19 nt, artificial
  Chemically synthesized
cucaauggaagaguaauca

SEQ ID NO: 1133 - RNA, 19 nt, artificial
  Chemically synthesized
auggaagaguaaucaacua

SEQ ID NO: 1134 - RNA, 19 nt, artificial
  Chemically synthesized
uggaagaguaaucaacuac

SEQ ID NO: 1135 - RNA, 19 nt, artificial
  Chemically synthesized
uaaagacaguauucaacac

SEQ ID NO: 1136 - RNA, 19 nt, artificial
  Chemically synthesized
aacaggggaaacugagcuu

SEQ ID NO: 1137 - RNA, 19 nt, artificial
  Chemically synthesized
ucuaaaacaacaccguggu

SEQ ID NO: 1138 - RNA, 19 nt, artificial
  Chemically synthesized
gugguuacugaaauggcac

SEQ ID NO: 1139 - RNA, 19 nt, artificial
  Chemically synthesized
ugguuacugaaauggcacc

SEQ ID NO: 1140 - RNA, 19 nt, artificial
  Chemically synthesized
ccaagaaacagugaagcag

SEQ ID NO: 1141 - RNA, 19 nt, artificial
  Chemically synthesized
aagaaacagugaagcaguu

SEQ ID NO: 1142 - RNA, 19 nt, artificial
  Chemically synthesized
ugaagcaguuccauuauug

SEQ ID NO: 1143 - RNA, 19 nt, artificial
  Chemically synthesized
uucucauuuacucuuaccu

SEQ ID NO: 1144 - RNA, 19 nt, artificial
  Chemically synthesized
aaacucaccuacuuaaucc

SEQ ID NO: 1145 - RNA, 19 nt, artificial
  Chemically synthesized
aacccuucaaauuugaguc

SEQ ID NO: 1146 - RNA, 19 nt, artificial
  Chemically synthesized
aucaaaauaggcaaaucug

SEQ ID NO: 1147 - RNA, 19 nt, artificial
  Chemically synthesized
ucaaaauaggcaaaucugg

SEQ ID NO: 1148 - RNA, 19 nt, artificial
  Chemically synthesized
aggcaaaucugguuuauau

SEQ ID NO: 1149 - RNA, 19 nt, artificial
  Chemically synthesized
uauagucuauuaccaagcc

SEQ ID NO: 1150 - RNA, 19 nt, artificial
  Chemically synthesized
cugaaaccaaauuguggaa

SEQ ID NO: 1151 - RNA, 19 nt, artificial
  Chemically synthesized
accaaauuguggaaucaaa

SEQ ID NO: 1152 - RNA, 19 nt, artificial
  Chemically synthesized
acuuuugcuuaccuauucc

SEQ ID NO: 1153 - RNA, 19 nt, artificial
  Chemically synthesized
uccaucccauucaauucug

SEQ ID NO: 1154 - RNA, 19 nt, artificial
  Chemically synthesized
ucuguacaaaaaugggauc

SEQ ID NO: 1155 - RNA, 19 nt, artificial
  Chemically synthesized
cuguacaaaaaugggaucu

SEQ ID NO: 1156 - RNA, 19 nt, artificial
  Chemically synthesized
cuaugcagaaaaucuacac

SEQ ID NO: 1157 - RNA, 19 nt, artificial
  Chemically synthesized
aaggccagaaaaucagccu

SEQ ID NO: 1158 - RNA, 19 nt, artificial
  Chemically synthesized
ugcaguugcuaugaaugug

SEQ ID NO: 1159 - RNA, 19 nt, artificial
  Chemically synthesized
uuauuuagggcaggugggg

SEQ ID NO: 1160 - RNA, 19 nt, artificial
  Chemically synthesized
acuacaaaugacuuuagcu

SEQ ID NO: 1161 - RNA, 19 nt, artificial
  Chemically synthesized
uacaaaugacuuuagcuga

SEQ ID NO: 1162 - RNA, 19 nt, artificial
  Chemically synthesized
gacuuuagcugacuagcug

SEQ ID NO: 1163 - RNA, 19 nt, artificial
  Chemically synthesized
ugaauaguuuuacuaccca

SEQ ID NO: 1164 - RNA, 19 nt, artificial
  Chemically synthesized
acccaaucaugaaauaauc

SEQ ID NO: 1165 - RNA, 19 nt, artificial
  Chemically synthesized
auuuucccuuuuuaggacc

SEQ ID NO: 1166 - RNA, 19 nt, artificial
  Chemically synthesized
cagcaauucugaaaugcug

SEQ ID NO: 1167 - RNA, 19 nt, artificial
  Chemically synthesized
gcaauucugaaaugcuggc

SEQ ID NO: 1168 - RNA, 19 nt, artificial
  Chemically synthesized
agcugaggaucagaguucu

SEQ ID NO: 1169 - RNA, 19 nt, artificial
  Chemically synthesized
acaggcagguggcuucuua

SEQ ID NO: 1170 - RNA, 19 nt, artificial
  Chemically synthesized
ucuccugaaaccagaggag

SEQ ID NO: 1171 - RNA, 19 nt, artificial
  Chemically synthesized
cuacuaaagaaaaaguccc

SEQ ID NO: 1172 - RNA, 19 nt, artificial
  Chemically synthesized
uuaaacacaaguguaagcu

SEQ ID NO: 1173 - RNA, 19 nt, artificial
  Chemically synthesized
gcucaaaaguagguacgac

SEQ ID NO: 1174 - RNA, 19 nt, artificial
  Chemically synthesized
caaaaguagguacgacgcu

SEQ ID NO: 1175 - RNA, 19 nt, artificial
  Chemically synthesized
acacaauccuauccagcuu

SEQ ID NO: 1176 - RNA, 19 nt, artificial
  Chemically synthesized
gcauaacacaaccucgcaa

SEQ ID NO: 1177 - RNA, 19 nt, artificial
  Chemically synthesized
cgcaggacaucuugagcaa

SEQ ID NO: 1178 - RNA, 19 nt, artificial
  Chemically synthesized
cuugagcaauucucugggu

SEQ ID NO: 1179 - RNA, 19 nt, artificial
  Chemically synthesized
caaguuuaguuugcuuuga

SEQ ID NO: 1180 - RNA, 19 nt, artificial
  Chemically synthesized
uaguuugcuuugauuugga

SEQ ID NO: 1181 - RNA, 19 nt, artificial
  Chemically synthesized
uaauuuaacagccuuccau

SEQ ID NO: 1182 - RNA, 19 nt, artificial
  Chemically synthesized
uuugcuuugauuuggacag

SEQ ID NO: 1183 - RNA, 19 nt, artificial
  Chemically synthesized
ugcuuugauuuggacagac

SEQ ID NO: 1184 - RNA, 19 nt, artificial
  Chemically synthesized
accauuuuguaagcauaac

SEQ ID NO: 1185 - RNA, 19 nt, artificial
  Chemically synthesized
uaacaggcaagagagucaa

SEQ ID NO: 1186 - RNA, 19 nt, artificial
  Chemically synthesized
aacuguuaguggaaaaagg

SEQ ID NO: 1187 - RNA, 19 nt, artificial
  Chemically synthesized
ugauuuggacagacaguuc

SEQ ID NO: 1188 - RNA, 19 nt, artificial
  Chemically synthesized
aguucuacaucgaugccca

SEQ ID NO: 1189 - RNA, 19 nt, artificial
  Chemically synthesized
agaaacacagugaaccuuu

SEQ ID NO: 1190 - RNA, 19 nt, artificial
  Chemically synthesized
aacacagugaaccuuugga

SEQ ID NO: 1191 - RNA, 19 nt, artificial
  Chemically synthesized
agcuuaacaauagacaugc

SEQ ID NO: 1192 - RNA, 19 nt, artificial
  Chemically synthesized
acaugcaaaacaacauuga

SEQ ID NO: 1193 - RNA, 19 nt, artificial
  Chemically synthesized
uugauuuaucuuggcccaa

SEQ ID NO: 1194 - RNA, 19 nt, artificial
  Chemically synthesized
ugauuuaucuuggcccaau

SEQ ID NO: 1195 - RNA, 19 nt, artificial
  Chemically synthesized
ucuauaaagauuggcuuug

SEQ ID NO: 1196 - RNA, 19 nt, artificial
  Chemically synthesized
auaaagauuggcuuuguag

SEQ ID NO: 1197 - RNA, 19 nt, artificial
  Chemically synthesized
agcauuugaagaguuuagu

SEQ ID NO: 1198 - RNA, 19 nt, artificial
  Chemically synthesized
guuuaguuuguuagaacac

SEQ ID NO: 1199 - RNA, 19 nt, artificial
  Chemically synthesized
uggcuaauuugaacaguga

SEQ ID NO: 1200 - RNA, 19 nt, artificial
  Chemically synthesized
cuuauaguaucaguaacag

SEQ ID NO: 1201 - RNA, 19 nt, artificial
  Chemically synthesized
uauaguaucaguaacagga

SEQ ID NO: 1202 - RNA, 19 nt, artificial
  Chemically synthesized
auaguaucaguaacaggau

SEQ ID NO: 1203 - RNA, 19 nt, artificial
  Chemically synthesized
aguaacaggaucacaccug

SEQ ID NO: 1204 - RNA, 19 nt, artificial
  Chemically synthesized
augaauacaucugucccua

SEQ ID NO: 1205 - RNA, 19 nt, artificial
  Chemically synthesized
gugaaguggagcuaauagc

SEQ ID NO: 1206 - RNA, 19 nt, artificial
  Chemically synthesized
uggagcuaauagcuagggc

SEQ ID NO: 1207 - RNA, 19 nt, artificial
  Chemically synthesized
auaagcuccuuauccacga

SEQ ID NO: 1208 - RNA, 19 nt, artificial
  Chemically synthesized
gcaaggauaugaaagccuu

SEQ ID NO: 1209 - RNA, 19 nt, artificial
  Chemically synthesized
auugaacauuguugagugg

SEQ ID NO: 1210 - RNA, 19 nt, artificial
  Chemically synthesized
gaacauuguugaguggagg

SEQ ID NO: 1211 - RNA, 19 nt, artificial
  Chemically synthesized
ucccuagugacagguaucc

SEQ ID NO: 1212 - RNA, 19 nt, artificial
  Chemically synthesized
agugacagguauccaaggu

SEQ ID NO: 1213 - RNA, 19 nt, artificial
  Chemically synthesized
augguuaucuggacgguga

SEQ ID NO: 1214 - RNA, 19 nt, artificial
  Chemically synthesized
guuaucuggacggugaguu

SEQ ID NO: 1215 - RNA, 19 nt, artificial
  Chemically synthesized
guacuauaaaccauaucuc

SEQ ID NO: 1216 - RNA, 19 nt, artificial
  Chemically synthesized
auaucuccauagccaaugc

SEQ ID NO: 1217 - RNA, 19 nt, artificial
  Chemically synthesized
ccucaaauauuaccucguu

SEQ ID NO: 1218 - RNA, 19 nt, artificial
  Chemically synthesized
cucaaauauuaccucguug

SEQ ID NO: 1219 - RNA, 19 nt, artificial
  Chemically synthesized
ucaaagugguaguauacag

SEQ ID NO: 1220 - RNA, 19 nt, artificial
  Chemically synthesized
aagugguaguauacagcua

SEQ ID NO: 1221 - RNA, 19 nt, artificial
  Chemically synthesized
agugguaguauacagcuac

SEQ ID NO: 1222 - RNA, 19 nt, artificial
  Chemically synthesized
agaugagauaacacugcca

SEQ ID NO: 1223 - RNA, 19 nt, artificial
  Chemically synthesized
ugaaaugguucaucugaga

SEQ ID NO: 1224 - RNA, 19 nt, artificial
  Chemically synthesized
aaugguucaucugagauua

SEQ ID NO: 1225 - RNA, 19 nt, artificial
  Chemically synthesized
cuaagugaaucagagaggg

SEQ ID NO: 1226 - RNA, 19 nt, artificial
  Chemically synthesized
agugaaucagagagggacu

SEQ ID NO: 1227 - RNA, 19 nt, artificial
  Chemically synthesized
gugaaucagagagggacua

SEQ ID NO: 1228 - RNA, 19 nt, artificial
  Chemically synthesized
ucaauggaagaguaaucaa

SEQ ID NO: 1229 - RNA, 19 nt, artificial
  Chemically synthesized
gaagaguaaucaacuacac

SEQ ID NO: 1230 - RNA, 19 nt, artificial
  Chemically synthesized
caacacuuaagaacagggg

SEQ ID NO: 1231 - RNA, 19 nt, artificial
  Chemically synthesized
acacuuaagaacaggggaa

SEQ ID NO: 1232 - RNA, 19 nt, artificial
  Chemically synthesized
uuaagaacaggggaaacug

SEQ ID NO: 1233 - RNA, 19 nt, artificial
  Chemically synthesized
aaacugagcuuauaaaggc

SEQ ID NO: 1234 - RNA, 19 nt, artificial
  Chemically synthesized
aaggcaucuaaaacaacac

SEQ ID NO: 1235 - RNA, 19 nt, artificial
  Chemically synthesized
gcaucuaaaacaacaccgu

SEQ ID NO: 1236 - RNA, 19 nt, artificial
  Chemically synthesized
aucuaaaacaacaccgugg

SEQ ID NO: 1237 - RNA, 19 nt, artificial
  Chemically synthesized
acaacaccgugguuacuga

SEQ ID NO: 1238 - RNA, 19 nt, artificial
  Chemically synthesized
accgugguuacugaaaugg

SEQ ID NO: 1239 - RNA, 19 nt, artificial
  Chemically synthesized
cucaccuacuuaauccuac

SEQ ID NO: 1240 - RNA, 19 nt, artificial
  Chemically synthesized
ucaccuacuuaauccuacc

SEQ ID NO: 1241 - RNA, 19 nt, artificial
  Chemically synthesized
uuccugucuaaaaacccuu

SEQ ID NO: 1242 - RNA, 19 nt, artificial
  Chemically synthesized
cugucuaaaaacccuucaa

SEQ ID NO: 1243 - RNA, 19 nt, artificial
  Chemically synthesized
aaauuugagucaggaacug

SEQ ID NO: 1244 - RNA, 19 nt, artificial
  Chemically synthesized
auuugagucaggaacuggu

SEQ ID NO: 1245 - RNA, 19 nt, artificial
  Chemically synthesized
uuuuggaaguuuugauagg

SEQ ID NO: 1246 - RNA, 19 nt, artificial
  Chemically synthesized
uagucaaaaucacuuagca

SEQ ID NO: 1247 - RNA, 19 nt, artificial
  Chemically synthesized
ccugaaaccaaauugugga

SEQ ID NO: 1248 - RNA, 19 nt, artificial
  Chemically synthesized
aaaccaaauuguggaauca

SEQ ID NO: 1249 - RNA, 19 nt, artificial
  Chemically synthesized
guacaaaaaugggaucuau

SEQ ID NO: 1250 - RNA, 19 nt, artificial
  Chemically synthesized
ucacuuagcaggcucucug

SEQ ID NO: 1251 - RNA, 19 nt, artificial
  Chemically synthesized
aucuaugcagaaaaucuac

SEQ ID NO: 1252 - RNA, 19 nt, artificial
  Chemically synthesized
augcagaaaaucuacacua

SEQ ID NO: 1253 - RNA, 19 nt, artificial
  Chemically synthesized
ugcagaaaaucuacacuau

SEQ ID NO: 1254 - RNA, 19 nt, artificial
  Chemically synthesized
uugcuaugaaugugaaaca

SEQ ID NO: 1255 - RNA, 19 nt, artificial
  Chemically synthesized
uucuuauuuagggcaggug

SEQ ID NO: 1256 - RNA, 19 nt, artificial
  Chemically synthesized
gcaaacuacaaaugacuuu

SEQ ID NO: 1257 - RNA, 19 nt, artificial
  Chemically synthesized
augacuuuagcugacuagc

SEQ ID NO: 1258 - RNA, 19 nt, artificial
  Chemically synthesized
acuuuagcugacuagcuga

SEQ ID NO: 1259 - RNA, 19 nt, artificial
  Chemically synthesized
cugaauaguuuuacuaccc

SEQ ID NO: 1260 - RNA, 19 nt, artificial
  Chemically synthesized
agcaauucugaaaugcugg

SEQ ID NO: 1261 - RNA, 19 nt, artificial
  Chemically synthesized
aagucgaaauccugagcug

SEQ ID NO: 1262 - RNA, 19 nt, artificial
  Chemically synthesized
gagcugaggaucagaguuc

SEQ ID NO: 1263 - RNA, 19 nt, artificial
  Chemically synthesized
ugaaaccagaggagaagcg

SEQ ID NO: 1264 - RNA, 19 nt, artificial
  Chemically synthesized
cucuacuaaagaaaaaguc

SEQ ID NO: 1265 - RNA, 19 nt, artificial
  Chemically synthesized
cuaaagaaaaagucccuga

SEQ ID NO: 1266 - RNA, 19 nt, artificial
  Chemically synthesized
uaaagaaaaagucccugaa

SEQ ID NO: 1267 - RNA, 19 nt, artificial
  Chemically synthesized
acaaguguaagcucaaaag

SEQ ID NO: 1268 - RNA, 19 nt, artificial
  Chemically synthesized
guaagcucaaaaguaggua

SEQ ID NO: 1269 - RNA, 19 nt, artificial
  Chemically synthesized
uaagcucaaaaguagguac

SEQ ID NO: 1270 - RNA, 19 nt, artificial
  Chemically synthesized
uuucaauuuccaaguucac

SEQ ID NO: 1271 - RNA, 19 nt, artificial
  Chemically synthesized
aauuuccaaguucacgugc

SEQ ID NO: 1272 - RNA, 19 nt, artificial
  Chemically synthesized
ugggucaguuucucaggga

SEQ ID NO: 1273 - RNA, 19 nt, artificial
  Chemically synthesized
uucucagggacaaggaccu

SEQ ID NO: 1274 - RNA, 19 nt, artificial
  Chemically synthesized
gcaaccaaguuuaguuugc

SEQ ID NO: 1275 - RNA, 19 nt, artificial
  Chemically synthesized
aguuugcuuugauuuggac

SEQ ID NO: 1276 - RNA, 19 nt, artificial
  Chemically synthesized
uugcuuugauuuggacaga

SEQ ID NO: 1277 - RNA, 19 nt, artificial
  Chemically synthesized
auuuuguaagcauaacagg

SEQ ID NO: 1278 - RNA, 19 nt, artificial
  Chemically synthesized
uuuuguaagcauaacaggc

SEQ ID NO: 1279 - RNA, 19 nt, artificial
  Chemically synthesized
agagagucaaagauaacug

SEQ ID NO: 1280 - RNA, 19 nt, artificial
  Chemically synthesized
ucaaagauaacuguuagug

SEQ ID NO: 1281 - RNA, 19 nt, artificial
  Chemically synthesized
aaagauaacuguuagugga

SEQ ID NO: 1282 - RNA, 19 nt, artificial
  Chemically synthesized
gauuuggacagacaguucu

SEQ ID NO: 1283 - RNA, 19 nt, artificial
  Chemically synthesized
aagaagccuugcccaguca

SEQ ID NO: 1284 - RNA, 19 nt, artificial
  Chemically synthesized
agcggcagaaacacaguga

SEQ ID NO: 1285 - RNA, 19 nt, artificial
  Chemically synthesized
cagaaacacagugaaccuu

SEQ ID NO: 1286 - RNA, 19 nt, artificial
  Chemically synthesized
caacauugauuuaucuugg

SEQ ID NO: 1287 - RNA, 19 nt, artificial
  Chemically synthesized
agauuggcuuuguaguauc

SEQ ID NO: 1288 - RNA, 19 nt, artificial
  Chemically synthesized
uuggcuuuguaguaucuuu

SEQ ID NO: 1289 - RNA, 19 nt, artificial
  Chemically synthesized
uggcuuuguaguaucuuuc

SEQ ID NO: 1290 - RNA, 19 nt, artificial
  Chemically synthesized
gcuuuguaguaucuuucca

SEQ ID NO: 1291 - RNA, 19 nt, artificial
  Chemically synthesized
cuuuguaguaucuuuccaa

SEQ ID NO: 1292 - RNA, 19 nt, artificial
  Chemically synthesized
uguaguaucuuuccaagca

SEQ ID NO: 1293 - RNA, 19 nt, artificial
  Chemically synthesized
guaguaucuuuccaagcau

SEQ ID NO: 1294 - RNA, 19 nt, artificial
  Chemically synthesized
aagcauuugaagaguuuag

SEQ ID NO: 1295 - RNA, 19 nt, artificial
  Chemically synthesized
gugacauuuuaggucacuu

SEQ ID NO: 1296 - RNA, 19 nt, artificial
  Chemically synthesized
aguaucaguaacaggauca

SEQ ID NO: 1297 - RNA, 19 nt, artificial
  Chemically synthesized
guaacaggaucacaccugu

SEQ ID NO: 1298 - RNA, 19 nt, artificial
  Chemically synthesized
uuuucaguaacaccaggau

SEQ ID NO: 1299 - RNA, 19 nt, artificial
  Chemically synthesized
aggaugaauacaucugucc

SEQ ID NO: 1300 - RNA, 19 nt, artificial
  Chemically synthesized
cagcaugugaaguggagcu

SEQ ID NO: 1301 - RNA, 19 nt, artificial
  Chemically synthesized
ugaaguggagcuaauagcu

SEQ ID NO: 1302 - RNA, 19 nt, artificial
  Chemically synthesized
uuaaccaaauucuggcaag

SEQ ID NO: 1303 - RNA, 19 nt, artificial
  Chemically synthesized
aaaccugaauaagcuccuu

SEQ ID NO: 1304 - RNA, 19 nt, artificial
  Chemically synthesized
acagcaaggauaugaaagc

SEQ ID NO: 1305 - RNA, 19 nt, artificial
  Chemically synthesized
uggaggcuaaauucucuca

SEQ ID NO: 1306 - RNA, 19 nt, artificial
  Chemically synthesized
ggaggcuaaauucucucau

SEQ ID NO: 1307 - RNA, 19 nt, artificial
  Chemically synthesized
auucuggcaaguugauucc

SEQ ID NO: 1308 - RNA, 19 nt, artificial
  Chemically synthesized
aggccuuuauuauucccua

SEQ ID NO: 1309 - RNA, 19 nt, artificial
  Chemically synthesized
cuuuauuauucccuaguga

SEQ ID NO: 1310 - RNA, 19 nt, artificial
  Chemically synthesized
uuauucccuagugacaggu

SEQ ID NO: 1311 - RNA, 19 nt, artificial
  Chemically synthesized
auucccuagugacagguau

SEQ ID NO: 1312 - RNA, 19 nt, artificial
  Chemically synthesized
ccuagugacagguauccaa

SEQ ID NO: 1313 - RNA, 19 nt, artificial
  Chemically synthesized
gugacagguauccaaggug

SEQ ID NO: 1314 - RNA, 19 nt, artificial
  Chemically synthesized
gcaugguuaucuggacggu

SEQ ID NO: 1315 - RNA, 19 nt, artificial
  Chemically synthesized
cauagccaaugcagacuuc

SEQ ID NO: 1316 - RNA, 19 nt, artificial
  Chemically synthesized
ugacccguuucaauaauuc

SEQ ID NO: 1317 - RNA, 19 nt, artificial
  Chemically synthesized
ugguaguauacagcuacua

SEQ ID NO: 1318 - RNA, 19 nt, artificial
  Chemically synthesized
uaguauacagcuacuaccc

SEQ ID NO: 1319 - RNA, 19 nt, artificial
  Chemically synthesized
uacagcuacuacccuugac

SEQ ID NO: 1320 - RNA, 19 nt, artificial
  Chemically synthesized
guuaaggagagauacuuca

SEQ ID NO: 1321 - RNA, 19 nt, artificial
  Chemically synthesized
uuaaggagagauacuucaa

SEQ ID NO: 1322 - RNA, 19 nt, artificial
  Chemically synthesized
gagagauacuucaauuccc

SEQ ID NO: 1323 - RNA, 19 nt, artificial
  Chemically synthesized
agagauacuucaauuccca

SEQ ID NO: 1324 - RNA, 19 nt, artificial
  Chemically synthesized
uucaauucccagaaaagcc

SEQ ID NO: 1325 - RNA, 19 nt, artificial
  Chemically synthesized
uuaccucguugagguuggg

SEQ ID NO: 1326 - RNA, 19 nt, artificial
  Chemically synthesized
agagaugagauaacacugc

SEQ ID NO: 1327 - RNA, 19 nt, artificial
  Chemically synthesized
gugaaaugguucaucugag

SEQ ID NO: 1328 - RNA, 19 nt, artificial
  Chemically synthesized
ucguugagguuggguucag

SEQ ID NO: 1329 - RNA, 19 nt, artificial
  Chemically synthesized
agauuacuaagugaaucag

SEQ ID NO: 1330 - RNA, 19 nt, artificial
  Chemically synthesized
auuacuaagugaaucagag

SEQ ID NO: 1331 - RNA, 19 nt, artificial
  Chemically synthesized
acuaagugaaucagagagg

SEQ ID NO: 1332 - RNA, 19 nt, artificial
  Chemically synthesized
gucaacggcucuguuuccu

SEQ ID NO: 1333 - RNA, 19 nt, artificial
  Chemically synthesized
uucacucaauggaagagua

SEQ ID NO: 1334 - RNA, 19 nt, artificial
  Chemically synthesized
agaguaaucaacuacacac

SEQ ID NO: 1335 - RNA, 19 nt, artificial
  Chemically synthesized
cacacaaaaauaucaguuc

SEQ ID NO: 1336 - RNA, 19 nt, artificial
  Chemically synthesized
aagacaguauucaacacuu

SEQ ID NO: 1337 - RNA, 19 nt, artificial
  Chemically synthesized
aacacuuaagaacagggga

SEQ ID NO: 1338 - RNA, 19 nt, artificial
  Chemically synthesized
agaacaggggaaacugagc

SEQ ID NO: 1339 - RNA, 19 nt, artificial
  Chemically synthesized
gaacaggggaaacugagcu

SEQ ID NO: 1340 - RNA, 19 nt, artificial
  Chemically synthesized
uucaggaacaacauaaucc

SEQ ID NO: 1341 - RNA, 19 nt, artificial
  Chemically synthesized
acaggggaaacugagcuua

SEQ ID NO: 1342 - RNA, 19 nt, artificial
  Chemically synthesized
aacugagcuuauaaaggca

SEQ ID NO: 1343 - RNA, 19 nt, artificial
  Chemically synthesized
ugagcuuauaaaggcaucu

SEQ ID NO: 1344 - RNA, 19 nt, artificial
  Chemically synthesized
agcuuauaaaggcaucuaa

SEQ ID NO: 1345 - RNA, 19 nt, artificial
  Chemically synthesized
ggcaucuaaaacaacaccg

SEQ ID NO: 1346 - RNA, 19 nt, artificial
  Chemically synthesized
uaaaacaacaccgugguua

SEQ ID NO: 1347 - RNA, 19 nt, artificial
  Chemically synthesized
aacaacauaaucccaguag

SEQ ID NO: 1348 - RNA, 19 nt, artificial
  Chemically synthesized
acaacauaaucccaguagu

SEQ ID NO: 1349 - RNA, 19 nt, artificial
  Chemically synthesized
aacagugaagcaguuccau

SEQ ID NO: 1350 - RNA, 19 nt, artificial
  Chemically synthesized
aguuccauuauugccguaa

SEQ ID NO: 1351 - RNA, 19 nt, artificial
  Chemically synthesized
gcuuuaauuaaacucaccu

SEQ ID NO: 1352 - RNA, 19 nt, artificial
  Chemically synthesized
aacucaccuacuuaauccu

SEQ ID NO: 1353 - RNA, 19 nt, artificial
  Chemically synthesized
cuuaauccuaccuuccugu

SEQ ID NO: 1354 - RNA, 19 nt, artificial
  Chemically synthesized
cuuccugucuaaaaacccu

SEQ ID NO: 1355 - RNA, 19 nt, artificial
  Chemically synthesized
uccugucuaaaaacccuuc

SEQ ID NO: 1356 - RNA, 19 nt, artificial
  Chemically synthesized
ccugucuaaaaacccuuca

SEQ ID NO: 1357 - RNA, 19 nt, artificial
  Chemically synthesized
ugucuaaaaacccuucaaa

SEQ ID NO: 1358 - RNA, 19 nt, artificial
  Chemically synthesized
ucccaguagucaaaaucac

SEQ ID NO: 1359 - RNA, 19 nt, artificial
  Chemically synthesized
cuucaaauuugagucagga

SEQ ID NO: 1360 - RNA, 19 nt, artificial
  Chemically synthesized
uccucugaaaacuuagaga

SEQ ID NO: 1361 - RNA, 19 nt, artificial
  Chemically synthesized
ucuauuaccaagccuaccu

SEQ ID NO: 1362 - RNA, 19 nt, artificial
  Chemically synthesized
cuaccugaaaccaaauugu

SEQ ID NO: 1363 - RNA, 19 nt, artificial
  Chemically synthesized
guggaaucaaauguaaaac

SEQ ID NO: 1364 - RNA, 19 nt, artificial
  Chemically synthesized
guaaaacucaaaugggcuu

SEQ ID NO: 1365 - RNA, 19 nt, artificial
  Chemically synthesized
aaacucaaaugggcuucua

SEQ ID NO: 1366 - RNA, 19 nt, artificial
  Chemically synthesized
ugggcuucuacuuuugcuu

SEQ ID NO: 1367 - RNA, 19 nt, artificial
  Chemically synthesized
uucuacuuuugcuuaccua

SEQ ID NO: 1368 - RNA, 19 nt, artificial
  Chemically synthesized
uacuuuugcuuaccuauuc

SEQ ID NO: 1369 - RNA, 19 nt, artificial
  Chemically synthesized
uugcuuaccuauuccaucc

SEQ ID NO: 1370 - RNA, 19 nt, artificial
  Chemically synthesized
ugcuuaccuauuccauccc

SEQ ID NO: 1371 - RNA, 19 nt, artificial
  Chemically synthesized
uuccaucccauucaauucu

SEQ ID NO: 1372 - RNA, 19 nt, artificial
  Chemically synthesized
aaaaaugggaucuaugcag

SEQ ID NO: 1373 - RNA, 19 nt, artificial
  Chemically synthesized
gaucuaugcagaaaaucua

SEQ ID NO: 1374 - RNA, 19 nt, artificial
  Chemically synthesized
aaucacuucuccaaaggcc

SEQ ID NO: 1375 - RNA, 19 nt, artificial
  Chemically synthesized
ucugggugauagccacagu

SEQ ID NO: 1376 - RNA, 19 nt, artificial
  Chemically synthesized
aaaggccagaaaaucagcc

SEQ ID NO: 1377 - RNA, 19 nt, artificial
  Chemically synthesized
ggccagaaaaucagccugu

SEQ ID NO: 1378 - RNA, 19 nt, artificial
  Chemically synthesized
gccagaaaaucagccuguu

SEQ ID NO: 1379 - RNA, 19 nt, artificial
  Chemically synthesized
aucagccuguuagcugcag

SEQ ID NO: 1380 - RNA, 19 nt, artificial
  Chemically synthesized
ccuguuagcugcaguugcu

SEQ ID NO: 1381 - RNA, 19 nt, artificial
  Chemically synthesized
cuguuagcugcaguugcua

SEQ ID NO: 1382 - RNA, 19 nt, artificial
  Chemically synthesized
uuagcugcaguugcuauga

SEQ ID NO: 1383 - RNA, 19 nt, artificial
  Chemically synthesized
gcaguugcuaugaauguga

SEQ ID NO: 1384 - RNA, 19 nt, artificial
  Chemically synthesized
ccacaguccagcaauucug

SEQ ID NO: 1385 - RNA, 19 nt, artificial
  Chemically synthesized
gggguuucuuauuuagggc

SEQ ID NO: 1386 - RNA, 19 nt, artificial
  Chemically synthesized
ucuuauuuagggcaggugg

SEQ ID NO: 1387 - RNA, 19 nt, artificial
  Chemically synthesized
ggggcaaacuacaaaugac

SEQ ID NO: 1388 - RNA, 19 nt, artificial
  Chemically synthesized
acuagcugaauaguuuuac

SEQ ID NO: 1389 - RNA, 19 nt, artificial
  Chemically synthesized
gaauaguuuuacuacccaa

SEQ ID NO: 1390 - RNA, 19 nt, artificial
  Chemically synthesized
ucgaaauccugagcugagg

SEQ ID NO: 1391 - RNA, 19 nt, artificial
  Chemically synthesized
cugaggaucagaguucucc

SEQ ID NO: 1392 - RNA, 19 nt, artificial
  Chemically synthesized
gaaaccagaggagaagcga

SEQ ID NO: 1393 - RNA, 19 nt, artificial
  Chemically synthesized
aaaccagaggagaagcgac

SEQ ID NO: 1394 - RNA, 19 nt, artificial
  Chemically synthesized
ucuacuaaagaaaaagucc

SEQ ID NO: 1395 - RNA, 19 nt, artificial
  Chemically synthesized
agucccugaagcuagucca

SEQ ID NO: 1396 - RNA, 19 nt, artificial
  Chemically synthesized
ugaagcuaguccaugagca

SEQ ID NO: 1397 - RNA, 19 nt, artificial
  Chemically synthesized
uguaagcucaaaaguaggu

SEQ ID NO: 1398 - RNA, 19 nt, artificial
  Chemically synthesized
agcucaaaaguagguacga

SEQ ID NO: 1399 - RNA, 19 nt, artificial
  Chemically synthesized
cucaaaaguagguacgacg

SEQ ID NO: 1400 - RNA, 19 nt, artificial
  Chemically synthesized
caauuuccaaguucacgug

SEQ ID NO: 1401 - RNA, 19 nt, artificial
  Chemically synthesized
ugcauaacacaaccucgca

SEQ ID NO: 1402 - RNA, 19 nt, artificial
  Chemically synthesized
gucaguuucucagggacaa

SEQ ID NO: 1403 - RNA, 19 nt, artificial
  Chemically synthesized
aguuucucagggacaagga

SEQ ID NO: 1404 - RNA, 19 nt, artificial
  Chemically synthesized
ccaguugcaaccaugguca

SEQ ID NO: 1405 - RNA, 19 nt, artificial
  Chemically synthesized
ugagcaaccaaguuuaguu

SEQ ID NO: 1406 - RNA, 19 nt, artificial
  Chemically synthesized
caaccaaguuuaguuugcu

SEQ ID NO: 1407 - RNA, 19 nt, artificial
  Chemically synthesized
ccauuuuguaagcauaaca

SEQ ID NO: 1408 - RNA, 19 nt, artificial
  Chemically synthesized
uuugauuuggacagacagu

SEQ ID NO: 1409 - RNA, 19 nt, artificial
  Chemically synthesized
agucaaagauaacuguuag

SEQ ID NO: 1410 - RNA, 19 nt, artificial
  Chemically synthesized
caguucuacaucgaugccc

SEQ ID NO: 1411 - RNA, 19 nt, artificial
  Chemically synthesized
aguggugacaacuccagga

SEQ ID NO: 1412 - RNA, 19 nt, artificial
  Chemically synthesized
aaccuuuggagcuuaacaa

SEQ ID NO: 1413 - RNA, 19 nt, artificial
  Chemically synthesized
cuuaacaauagacaugcaa

SEQ ID NO: 1414 - RNA, 19 nt, artificial
  Chemically synthesized
uagacaugcaaaacaacau

SEQ ID NO: 1415 - RNA, 19 nt, artificial
  Chemically synthesized
auuggcuuuguaguaucuu

SEQ ID NO: 1416 - RNA, 19 nt, artificial
  Chemically synthesized
uuuguaguaucuuuccaag

SEQ ID NO: 1417 - RNA, 19 nt, artificial
  Chemically synthesized
gcuaauuugaacagugaca

SEQ ID NO: 1418 - RNA, 19 nt, artificial
  Chemically synthesized
uaggucacuuauaguauca

SEQ ID NO: 1419 - RNA, 19 nt, artificial
  Chemically synthesized
uugcaaccauggucaacgg

SEQ ID NO: 1420 - RNA, 19 nt, artificial
  Chemically synthesized
accuguuuuucaguaacac

SEQ ID NO: 1421 - RNA, 19 nt, artificial
  Chemically synthesized
gaugaauacaucugucccu

SEQ ID NO: 1422 - RNA, 19 nt, artificial
  Chemically synthesized
auacaucugucccuacgcc

SEQ ID NO: 1423 - RNA, 19 nt, artificial
  Chemically synthesized
uccagcaugugaaguggag

SEQ ID NO: 1424 - RNA, 19 nt, artificial
  Chemically synthesized
cuaauagcuagggcaggaa

SEQ ID NO: 1425 - RNA, 19 nt, artificial
  Chemically synthesized
gaaaccugaauaagcuccu

SEQ ID NO: 1426 - RNA, 19 nt, artificial
  Chemically synthesized
accugaauaagcuccuuau

SEQ ID NO: 1427 - RNA, 19 nt, artificial
  Chemically synthesized
accaaauucuggcaaguug

SEQ ID NO: 1428 - RNA, 19 nt, artificial
  Chemically synthesized
augaaagccuugcugaauu

SEQ ID NO: 1429 - RNA, 19 nt, artificial
  Chemically synthesized
cugaauugaacauuguuga

SEQ ID NO: 1430 - RNA, 19 nt, artificial
  Chemically synthesized
uugaacauuguugagugga

SEQ ID NO: 1431 - RNA, 19 nt, artificial
  Chemically synthesized
augaucuacuuaguuggaa

SEQ ID NO: 1432 - RNA, 19 nt, artificial
  Chemically synthesized
aaggccuuuauuauucccu

SEQ ID NO: 1433 - RNA, 19 nt, artificial
  Chemically synthesized
ccuuuauuauucccuagug

SEQ ID NO: 1434 - RNA, 19 nt, artificial
  Chemically synthesized
ucuggcaaguugauuccuc

SEQ ID NO: 1435 - RNA, 19 nt, artificial
  Chemically synthesized
auuauucccuagugacagg

SEQ ID NO: 1436 - RNA, 19 nt, artificial
  Chemically synthesized
aaaucugggugcaugcaug

SEQ ID NO: 1437 - RNA, 19 nt, artificial
  Chemically synthesized
caugcaugguuaucuggac

SEQ ID NO: 1438 - RNA, 19 nt, artificial
  Chemically synthesized
ugcaugguuaucuggacgg

SEQ ID NO: 1439 - RNA, 19 nt, artificial
  Chemically synthesized
uggacggugaguuucauuc

SEQ ID NO: 1440 - RNA, 19 nt, artificial
  Chemically synthesized
gacggugaguuucauucuc

SEQ ID NO: 1441 - RNA, 19 nt, artificial
  Chemically synthesized
guuucauucucuaggcugu

SEQ ID NO: 1442 - RNA, 19 nt, artificial
  Chemically synthesized
aucuccauagccaaugcag

SEQ ID NO: 1443 - RNA, 19 nt, artificial
  Chemically synthesized
uccauagccaaugcagacu

SEQ ID NO: 1444 - RNA, 19 nt, artificial
  Chemically synthesized
ccauagccaaugcagacuu

SEQ ID NO: 1445 - RNA, 19 nt, artificial
  Chemically synthesized
acccguuucaauaauucaa

SEQ ID NO: 1446 - RNA, 19 nt, artificial
  Chemically synthesized
caaagugguaguauacagc

SEQ ID NO: 1447 - RNA, 19 nt, artificial
  Chemically synthesized
guauacagcuacuacccuu

SEQ ID NO: 1448 - RNA, 19 nt, artificial
  Chemically synthesized
gguuaaggagagauacuuc

SEQ ID NO: 1449 - RNA, 19 nt, artificial
  Chemically synthesized
gauacuucaauucccagaa

SEQ ID NO: 1450 - RNA, 19 nt, artificial
  Chemically synthesized
accucguugagguuggguu

SEQ ID NO: 1451 - RNA, 19 nt, artificial
  Chemically synthesized
ccauggugaaaugguucau

SEQ ID NO: 1452 - RNA, 19 nt, artificial
  Chemically synthesized
auggugaaaugguucaucu

SEQ ID NO: 1453 - RNA, 19 nt, artificial
  Chemically synthesized
aaaugguucaucugagauu

SEQ ID NO: 1454 - RNA, 19 nt, artificial
  Chemically synthesized
ucaucugagauuaagcaca

SEQ ID NO: 1455 - RNA, 19 nt, artificial
  Chemically synthesized
caucugagauuaagcacau

SEQ ID NO: 1456 - RNA, 19 nt, artificial
  Chemically synthesized
ucugagauuaagcacaugu

SEQ ID NO: 1457 - RNA, 19 nt, artificial
  Chemically synthesized
cugagauuaagcacaugua

SEQ ID NO: 1458 - RNA, 19 nt, artificial
  Chemically synthesized
auguaauacugaaaagagg

SEQ ID NO: 1459 - RNA, 19 nt, artificial
  Chemically synthesized
uacuaagugaaucagagag

SEQ ID NO: 1460 - RNA, 19 nt, artificial
  Chemically synthesized
uuggguucaggaacaacau

SEQ ID NO: 1461 - RNA, 19 nt, artificial
  Chemically synthesized
ucaacacuuaagaacaggg

SEQ ID NO: 1462 - RNA, 19 nt, artificial
  Chemically synthesized
acugagcuuauaaaggcau

SEQ ID NO: 1463 - RNA, 19 nt, artificial
  Chemically synthesized
aggaacaacauaaucccag

SEQ ID NO: 1464 - RNA, 19 nt, artificial
  Chemically synthesized
ugccucuuuaaaacauuag

SEQ ID NO: 1465 - RNA, 19 nt, artificial
  Chemically synthesized
acauaaucccaguagucaa

SEQ ID NO: 1466 - RNA, 19 nt, artificial
  Chemically synthesized
auugccguaauauuucuca

SEQ ID NO: 1467 - RNA, 19 nt, artificial
  Chemically synthesized
uugccguaauauuucucau

SEQ ID NO: 1468 - RNA, 19 nt, artificial
  Chemically synthesized
uuucucauuuacucuuacc

SEQ ID NO: 1469 - RNA, 19 nt, artificial
  Chemically synthesized
cucauuuacucuuaccuag

SEQ ID NO: 1470 - RNA, 19 nt, artificial
  Chemically synthesized
uuuacucuuaccuaggguu

SEQ ID NO: 1471 - RNA, 19 nt, artificial
  Chemically synthesized
agcuuuaauuaaacucacc

SEQ ID NO: 1472 - RNA, 19 nt, artificial
  Chemically synthesized
aauccuaccuuccugucua

SEQ ID NO: 1473 - RNA, 19 nt, artificial
  Chemically synthesized
acccuucaaauuugaguca

SEQ ID NO: 1474 - RNA, 19 nt, artificial
  Chemically synthesized
cccuucaaauuugagucag

SEQ ID NO: 1475 - RNA, 19 nt, artificial
  Chemically synthesized
uuugagucaggaacuggug

SEQ ID NO: 1476 - RNA, 19 nt, artificial
  Chemically synthesized
ugagucaggaacugguggu

SEQ ID NO: 1477 - RNA, 19 nt, artificial
  Chemically synthesized
aacugguggugugggcuuu

SEQ ID NO: 1478 - RNA, 19 nt, artificial
  Chemically synthesized
uagucuauuaccaagccua

SEQ ID NO: 1479 - RNA, 19 nt, artificial
  Chemically synthesized
ccuaccugaaaccaaauug

SEQ ID NO: 1480 - RNA, 19 nt, artificial
  Chemically synthesized
uguaaaacucaaaugggcu

SEQ ID NO: 1481 - RNA, 19 nt, artificial
  Chemically synthesized
ucaaaaucacuuagcaggc

SEQ ID NO: 1482 - RNA, 19 nt, artificial
  Chemically synthesized
augggcuucuacuuuugcu

SEQ ID NO: 1483 - RNA, 19 nt, artificial
  Chemically synthesized
ggcuucuacuuuugcuuac

SEQ ID NO: 1484 - RNA, 19 nt, artificial
  Chemically synthesized
aaucacuuagcaggcucuc

SEQ ID NO: 1485 - RNA, 19 nt, artificial
  Chemically synthesized
acaaaaaugggaucuaugc

SEQ ID NO: 1486 - RNA, 19 nt, artificial
  Chemically synthesized
uaugcagaaaaucuacacu

SEQ ID NO: 1487 - RNA, 19 nt, artificial
  Chemically synthesized
auuuugaaucacuucucca

SEQ ID NO: 1488 - RNA, 19 nt, artificial
  Chemically synthesized
ucagccuguuagcugcagu

SEQ ID NO: 1489 - RNA, 19 nt, artificial
  Chemically synthesized
cuaugaaugugaaacacag

SEQ ID NO: 1490 - RNA, 19 nt, artificial
  Chemically synthesized
augaaugugaaacacagaa

SEQ ID NO: 1491 - RNA, 19 nt, artificial
  Chemically synthesized
aaaagagacuacauuuggg

SEQ ID NO: 1492 - RNA, 19 nt, artificial
  Chemically synthesized
aaagagacuacauuugggg

SEQ ID NO: 1493 - RNA, 19 nt, artificial
  Chemically synthesized
agagacuacauuugggguu

SEQ ID NO: 1494 - RNA, 19 nt, artificial
  Chemically synthesized
gguuucuuauuuagggcag

SEQ ID NO: 1495 - RNA, 19 nt, artificial
  Chemically synthesized
uuucuuauuuagggcaggu

SEQ ID NO: 1496 - RNA, 19 nt, artificial
  Chemically synthesized
cuuauuuagggcagguggg

SEQ ID NO: 1497 - RNA, 19 nt, artificial
  Chemically synthesized
uguuguuccaaucagugag

SEQ ID NO: 1498 - RNA, 19 nt, artificial
  Chemically synthesized
aacaagucgaaauccugag

SEQ ID NO: 1499 - RNA, 19 nt, artificial
  Chemically synthesized
acaagucgaaauccugagc

SEQ ID NO: 1500 - RNA, 19 nt, artificial
  Chemically synthesized
caagucgaaauccugagcu

SEQ ID NO: 1501 - RNA, 19 nt, artificial
  Chemically synthesized
ugaggaucagaguucuccu

SEQ ID NO: 1502 - RNA, 19 nt, artificial
  Chemically synthesized
ucuugcugcucaaacugcc

SEQ ID NO: 1503 - RNA, 19 nt, artificial
  Chemically synthesized
aaacacaaguguaagcuca

SEQ ID NO: 1504 - RNA, 19 nt, artificial
  Chemically synthesized
acacaaguguaagcucaaa

SEQ ID NO: 1505 - RNA, 19 nt, artificial
  Chemically synthesized
cgacgcuagaaucacacac

SEQ ID NO: 1506 - RNA, 19 nt, artificial
  Chemically synthesized
acgcuagaaucacacacaa

SEQ ID NO: 1507 - RNA, 19 nt, artificial
  Chemically synthesized
ucacacacaauccuaucca

SEQ ID NO: 1508 - RNA, 19 nt, artificial
  Chemically synthesized
acaauccuauccagcuuuu

SEQ ID NO: 1509 - RNA, 19 nt, artificial
  Chemically synthesized
uauccagcuuuuuacauac

SEQ ID NO: 1510 - RNA, 19 nt, artificial
  Chemically synthesized
uccagcuuuuuacauacau

SEQ ID NO: 1511 - RNA, 19 nt, artificial
  Chemically synthesized
gagcaauucucugggucag

SEQ ID NO: 1512 - RNA, 19 nt, artificial
  Chemically synthesized
aacugccaguugcaaccau

SEQ ID NO: 1513 - RNA, 19 nt, artificial
  Chemically synthesized
uuaauuuaacagccuucca

SEQ ID NO: 1514 - RNA, 19 nt, artificial
  Chemically synthesized
uuaacagccuuccauaagc

SEQ ID NO: 1515 - RNA, 19 nt, artificial
  Chemically synthesized
cuuugauuuggacagacag

SEQ ID NO: 1516 - RNA, 19 nt, artificial
  Chemically synthesized
aaggacaacaguucuacau

SEQ ID NO: 1517 - RNA, 19 nt, artificial
  Chemically synthesized
aacaguucuacaucgaugc

SEQ ID NO: 1518 - RNA, 19 nt, artificial
  Chemically synthesized
agacaugcaaaacaacauu

SEQ ID NO: 1519 - RNA, 19 nt, artificial
  Chemically synthesized
auugauuuaucuuggccca

SEQ ID NO: 1520 - RNA, 19 nt, artificial
  Chemically synthesized
auuuaucuuggcccaauuc

SEQ ID NO: 1521 - RNA, 19 nt, artificial
  Chemically synthesized
uuuaucuuggcccaauucu

SEQ ID NO: 1522 - RNA, 19 nt, artificial
  Chemically synthesized
uuuccaagcauuugaagag

SEQ ID NO: 1523 - RNA, 19 nt, artificial
  Chemically synthesized
uuccaagcauuugaagagu

SEQ ID NO: 1524 - RNA, 19 nt, artificial
  Chemically synthesized
ggcuaauuugaacagugac

SEQ ID NO: 1525 - RNA, 19 nt, artificial
  Chemically synthesized
cagugacauuuuaggucac

SEQ ID NO: 1526 - RNA, 19 nt, artificial
  Chemically synthesized
aggucacuuauaguaucag

SEQ ID NO: 1527 - RNA, 19 nt, artificial
  Chemically synthesized
ggucacuuauaguaucagu

SEQ ID NO: 1528 - RNA, 19 nt, artificial
  Chemically synthesized
gucacuuauaguaucagua

SEQ ID NO: 1529 - RNA, 19 nt, artificial
  Chemically synthesized
uaguaucaguaacaggauc

SEQ ID NO: 1530 - RNA, 19 nt, artificial
  Chemically synthesized
ucaguaacaggaucacacc

SEQ ID NO: 1531 - RNA, 19 nt, artificial
  Chemically synthesized
gaucacaccuguuuuucag

SEQ ID NO: 1532 - RNA, 19 nt, artificial
  Chemically synthesized
cuguuuuucaguaacacca

SEQ ID NO: 1533 - RNA, 19 nt, artificial
  Chemically synthesized
uguuuuucaguaacaccag

SEQ ID NO: 1534 - RNA, 19 nt, artificial
  Chemically synthesized
uuuuucaguaacaccagga

SEQ ID NO: 1535 - RNA, 19 nt, artificial
  Chemically synthesized
ccaggaugaauacaucugu

SEQ ID NO: 1536 - RNA, 19 nt, artificial
  Chemically synthesized
caggaugaauacaucuguc

SEQ ID NO: 1537 - RNA, 19 nt, artificial
  Chemically synthesized
aauacaucugucccuacgc

SEQ ID NO: 1538 - RNA, 19 nt, artificial
  Chemically synthesized
gcuaauagcuagggcagga

SEQ ID NO: 1539 - RNA, 19 nt, artificial
  Chemically synthesized
gaauaagcuccuuauccac

SEQ ID NO: 1540 - RNA, 19 nt, artificial
  Chemically synthesized
uuauccacgacccacagca

SEQ ID NO: 1541 - RNA, 19 nt, artificial
  Chemically synthesized
aauucuggcaaguugauuc

SEQ ID NO: 1542 - RNA, 19 nt, artificial
  Chemically synthesized
uaaugaucuacuuaguugg

SEQ ID NO: 1543 - RNA, 19 nt, artificial
  Chemically synthesized
gacaaaaaauaaggccuuu

SEQ ID NO: 1544 - RNA, 19 nt, artificial
  Chemically synthesized
auaaggccuuuauuauucc

SEQ ID NO: 1545 - RNA, 19 nt, artificial
  Chemically synthesized
uaaggccuuuauuauuccc

SEQ ID NO: 1546 - RNA, 19 nt, artificial
  Chemically synthesized
ucugggugcaugcaugguu

SEQ ID NO: 1547 - RNA, 19 nt, artificial
  Chemically synthesized
gugcaugcaugguuaucug

SEQ ID NO: 1548 - RNA, 19 nt, artificial
  Chemically synthesized
ugguuaucuggacggugag

SEQ ID NO: 1549 - RNA, 19 nt, artificial
  Chemically synthesized
ucuggacggugaguuucau

SEQ ID NO: 1550 - RNA, 19 nt, artificial
  Chemically synthesized
acggugaguuucauucucu

SEQ ID NO: 1551 - RNA, 19 nt, artificial
  Chemically synthesized
uucauucucuaggcuguac

SEQ ID NO: 1552 - RNA, 19 nt, artificial
  Chemically synthesized
aggcuguacuauaaaccau

SEQ ID NO: 1553 - RNA, 19 nt, artificial
  Chemically synthesized
cuauaaaccauaucuccau

SEQ ID NO: 1554 - RNA, 19 nt, artificial
  Chemically synthesized
aaccauaucuccauagcca

SEQ ID NO: 1555 - RNA, 19 nt, artificial
  Chemically synthesized
uaucuccauagccaaugca

SEQ ID NO: 1556 - RNA, 19 nt, artificial
  Chemically synthesized
auucaaagugguaguauac

SEQ ID NO: 1557 - RNA, 19 nt, artificial
  Chemically synthesized
aaagugguaguauacagcu

SEQ ID NO: 1558 - RNA, 19 nt, artificial
  Chemically synthesized
guaguauacagcuacuacc

SEQ ID NO: 1559 - RNA, 19 nt, artificial
  Chemically synthesized
uauacagcuacuacccuug

SEQ ID NO: 1560 - RNA, 19 nt, artificial
  Chemically synthesized
ugacaauugggguuaagga

SEQ ID NO: 1561 - RNA, 19 nt, artificial
  Chemically synthesized
ggguuaaggagagauacuu

SEQ ID NO: 1562 - RNA, 19 nt, artificial
  Chemically synthesized
agauacuucaauucccaga

SEQ ID NO: 1563 - RNA, 19 nt, artificial
  Chemically synthesized
auacuucaauucccagaaa

SEQ ID NO: 1564 - RNA, 19 nt, artificial
  Chemically synthesized
gagaugagauaacacugcc

SEQ ID NO: 1565 - RNA, 19 nt, artificial
  Chemically synthesized
gaugagauaacacugccau

SEQ ID NO: 1566 - RNA, 19 nt, artificial
  Chemically synthesized
agauaacacugccauggug

SEQ ID NO: 1567 - RNA, 19 nt, artificial
  Chemically synthesized
guucaucugagauuaagca

SEQ ID NO: 1568 - RNA, 19 nt, artificial
  Chemically synthesized
aucugagauuaagcacaug

SEQ ID NO: 1569 - RNA, 19 nt, artificial
  Chemically synthesized
ugagauuaagcacauguaa

SEQ ID NO: 1570 - RNA, 19 nt, artificial
  Chemically synthesized
uuaagcacauguaauacug

SEQ ID NO: 1571 - RNA, 19 nt, artificial
  Chemically synthesized
aggauagauuacuaaguga

SEQ ID NO: 1572 - RNA, 19 nt, artificial
  Chemically synthesized
uaauuuccuauccucacag

SEQ ID NO: 1573 - RNA, 19 nt, artificial
  Chemically synthesized
aaagacaguauucaacacu

SEQ ID NO: 1574 - RNA, 19 nt, artificial
  Chemically synthesized
agacaguauucaacacuua

SEQ ID NO: 1575 - RNA, 19 nt, artificial
  Chemically synthesized
auucaacacuuaagaacag

SEQ ID NO: 1576 - RNA, 19 nt, artificial
  Chemically synthesized
uucaacacuuaagaacagg

SEQ ID NO: 1577 - RNA, 19 nt, artificial
  Chemically synthesized
cugagcuuauaaaggcauc

SEQ ID NO: 1578 - RNA, 19 nt, artificial
  Chemically synthesized
gagcuuauaaaggcaucua

SEQ ID NO: 1579 - RNA, 19 nt, artificial
  Chemically synthesized
aggcaucuaaaacaacacc

SEQ ID NO: 1580 - RNA, 19 nt, artificial
  Chemically synthesized
agcuuuuguugccucuuua

SEQ ID NO: 1581 - RNA, 19 nt, artificial
  Chemically synthesized
uuuguugccucuuuaaaac

SEQ ID NO: 1582 - RNA, 19 nt, artificial
  Chemically synthesized
uguugccucuuuaaaacau

SEQ ID NO: 1583 - RNA, 19 nt, artificial
  Chemically synthesized
caccaagaaacagugaagc

SEQ ID NO: 1584 - RNA, 19 nt, artificial
  Chemically synthesized
uauugccguaauauuucuc

SEQ ID NO: 1585 - RNA, 19 nt, artificial
  Chemically synthesized
aaacccuucaaauuugagu

SEQ ID NO: 1586 - RNA, 19 nt, artificial
  Chemically synthesized
ccaguagucaaaaucacuu

SEQ ID NO: 1587 - RNA, 19 nt, artificial
  Chemically synthesized
caguagucaaaaucacuua

SEQ ID NO: 1588 - RNA, 19 nt, artificial
  Chemically synthesized
cauuuaguaugauucugug

SEQ ID NO: 1589 - RNA, 19 nt, artificial
  Chemically synthesized
guagucaaaaucacuuagc

SEQ ID NO: 1590 - RNA, 19 nt, artificial
  Chemically synthesized
cuauuaccaagccuaccug

SEQ ID NO: 1591 - RNA, 19 nt, artificial
  Chemically synthesized
gcuuaccuauuccauccca

SEQ ID NO: 1592 - RNA, 19 nt, artificial
  Chemically synthesized
cuuaccuauuccaucccau

SEQ ID NO: 1593 - RNA, 19 nt, artificial
  Chemically synthesized
acagaaagaaaagagacua

SEQ ID NO: 1594 - RNA, 19 nt, artificial
  Chemically synthesized
acuacauuugggguuucuu

SEQ ID NO: 1595 - RNA, 19 nt, artificial
  Chemically synthesized
ugggguuucuuauuuaggg

SEQ ID NO: 1596 - RNA, 19 nt, artificial
  Chemically synthesized
ccuucaaucacuguuguuc

SEQ ID NO: 1597 - RNA, 19 nt, artificial
  Chemically synthesized
ucacuguuguuccaaucag

SEQ ID NO: 1598 - RNA, 19 nt, artificial
  Chemically synthesized
aaauccugagcugaggauc

SEQ ID NO: 1599 - RNA, 19 nt, artificial
  Chemically synthesized
ggaucagaguucuccugaa

SEQ ID NO: 1600 - RNA, 19 nt, artificial
  Chemically synthesized
ggagaagcgaccucuacua

SEQ ID NO: 1601 - RNA, 19 nt, artificial
  Chemically synthesized
aagaaaaagucccugaagc

SEQ ID NO: 1602 - RNA, 19 nt, artificial
  Chemically synthesized
augagcaguucuccugcuu

SEQ ID NO: 1603 - RNA, 19 nt, artificial
  Chemically synthesized
uaaacacaaguguaagcuc

SEQ ID NO: 1604 - RNA, 19 nt, artificial
  Chemically synthesized
uacgacgcuagaaucacac

SEQ ID NO: 1605 - RNA, 19 nt, artificial
  Chemically synthesized
uagaaucacacacaauccu

SEQ ID NO: 1606 - RNA, 19 nt, artificial
  Chemically synthesized
uuucucagggacaaggacc

SEQ ID NO: 1607 - RNA, 19 nt, artificial
  Chemically synthesized
uaagccaucaccauuuugu

SEQ ID NO: 1608 - RNA, 19 nt, artificial
  Chemically synthesized
agcauaacaggcaagagag

SEQ ID NO: 1609 - RNA, 19 nt, artificial
  Chemically synthesized
aggcaagagagucaaagau

SEQ ID NO: 1610 - RNA, 19 nt, artificial
  Chemically synthesized
aagauaacuguuaguggaa

SEQ ID NO: 1611 - RNA, 19 nt, artificial
  Chemically synthesized
gacaacaguucuacaucga

SEQ ID NO: 1612 - RNA, 19 nt, artificial
  Chemically synthesized
ucuacaucgaugcccaaga

SEQ ID NO: 1613 - RNA, 19 nt, artificial
  Chemically synthesized
ucgaugcccaagaagccuu

SEQ ID NO: 1614 - RNA, 19 nt, artificial
  Chemically synthesized
uuggagcuuaacaauagac

SEQ ID NO: 1615 - RNA, 19 nt, artificial
  Chemically synthesized
uggagcuuaacaauagaca

SEQ ID NO: 1616 - RNA, 19 nt, artificial
  Chemically synthesized
gcuuaacaauagacaugca

SEQ ID NO: 1617 - RNA, 19 nt, artificial
  Chemically synthesized
acaauagacaugcaaaaca

SEQ ID NO: 1618 - RNA, 19 nt, artificial
  Chemically synthesized
caauagacaugcaaaacaa

SEQ ID NO: 1619 - RNA, 19 nt, artificial
  Chemically synthesized
agugacauuuuaggucacu

SEQ ID NO: 1620 - RNA, 19 nt, artificial
  Chemically synthesized
cacuuauaguaucaguaac

SEQ ID NO: 1621 - RNA, 19 nt, artificial
  Chemically synthesized
aacaggaucacaccuguuu

SEQ ID NO: 1622 - RNA, 19 nt, artificial
  Chemically synthesized
uucaguaacaccaggauga

SEQ ID NO: 1623 - RNA, 19 nt, artificial
  Chemically synthesized
acaccaggaugaauacauc

SEQ ID NO: 1624 - RNA, 19 nt, artificial
  Chemically synthesized
aaguggagcuaauagcuag

SEQ ID NO: 1625 - RNA, 19 nt, artificial
  Chemically synthesized
aaccugaauaagcuccuua

SEQ ID NO: 1626 - RNA, 19 nt, artificial
  Chemically synthesized
uaagcuccuuauccacgac

SEQ ID NO: 1627 - RNA, 19 nt, artificial
  Chemically synthesized
uccuuauccacgacccaca

SEQ ID NO: 1628 - RNA, 19 nt, artificial
  Chemically synthesized
cccacagcaaggauaugaa

SEQ ID NO: 1629 - RNA, 19 nt, artificial
  Chemically synthesized
aggcuaaauucucucauua

SEQ ID NO: 1630 - RNA, 19 nt, artificial
  Chemically synthesized
gcuaaauucucucauuaac

SEQ ID NO: 1631 - RNA, 19 nt, artificial
  Chemically synthesized
ucuacuuaguuggaauaag

SEQ ID NO: 1632 - RNA, 19 nt, artificial
  Chemically synthesized
cuuaguuggaauaagacaa

SEQ ID NO: 1633 - RNA, 19 nt, artificial
  Chemically synthesized
uuuauuauucccuagugac

SEQ ID NO: 1634 - RNA, 19 nt, artificial
  Chemically synthesized
uauuauucccuagugacag

SEQ ID NO: 1635 - RNA, 19 nt, artificial
  Chemically synthesized
augcaugguuaucuggacg

SEQ ID NO: 1636 - RNA, 19 nt, artificial
  Chemically synthesized
cggugaguuucauucucua

SEQ ID NO: 1637 - RNA, 19 nt, artificial
  Chemically synthesized
caauaauucaaagugguag

SEQ ID NO: 1638 - RNA, 19 nt, artificial
  Chemically synthesized
acagcuacuacccuugaca

SEQ ID NO: 1639 - RNA, 19 nt, artificial
  Chemically synthesized
caauugggguuaaggagag

SEQ ID NO: 1640 - RNA, 19 nt, artificial
  Chemically synthesized
cauggugaaaugguucauc

SEQ ID NO: 1641 - RNA, 19 nt, artificial
  Chemically synthesized
agcacauguaauacugaaa

SEQ ID NO: 1642 - RNA, 19 nt, artificial
  Chemically synthesized
uugagguuggguucaggaa

SEQ ID NO: 1643 - RNA, 19 nt, artificial
  Chemically synthesized
ugaaaagaggauagauuac

SEQ ID NO: 1644 - RNA, 19 nt, artificial
  Chemically synthesized
agguuggguucaggaacaa

SEQ ID NO: 1645 - RNA, 19 nt, artificial
  Chemically synthesized
gaucucagaacuaauuucc

SEQ ID NO: 1646 - RNA, 19 nt, artificial
  Chemically synthesized
agaacuaauuuccuauccu

SEQ ID NO: 1647 - RNA, 19 nt, artificial
  Chemically synthesized
cuaauuuccuauccucaca

SEQ ID NO: 1648 - RNA, 19 nt, artificial
  Chemically synthesized
aauuuccuauccucacagg

SEQ ID NO: 1649 - RNA, 19 nt, artificial
  Chemically synthesized
cuacacacaaaaauaucag

SEQ ID NO: 1650 - RNA, 19 nt, artificial
  Chemically synthesized
guauucaacacuuaagaac

SEQ ID NO: 1651 - RNA, 19 nt, artificial
  Chemically synthesized
ggaacaacauaaucccagu

SEQ ID NO: 1652 - RNA, 19 nt, artificial
  Chemically synthesized
uuagagugaggaagucacc

SEQ ID NO: 1653 - RNA, 19 nt, artificial
  Chemically synthesized
agagugaggaagucaccaa

SEQ ID NO: 1654 - RNA, 19 nt, artificial
  Chemically synthesized
aagucaccaagaaacagug

SEQ ID NO: 1655 - RNA, 19 nt, artificial
  Chemically synthesized
ucaccaagaaacagugaag

SEQ ID NO: 1656 - RNA, 19 nt, artificial
  Chemically synthesized
uuccauuauugccguaaua

SEQ ID NO: 1657 - RNA, 19 nt, artificial
  Chemically synthesized
ucucauuuacucuuaccua

SEQ ID NO: 1658 - RNA, 19 nt, artificial
  Chemically synthesized
cauuuacucuuaccuaggg

SEQ ID NO: 1659 - RNA, 19 nt, artificial
  Chemically synthesized
auccuaccuuccugucuaa

SEQ ID NO: 1660 - RNA, 19 nt, artificial
  Chemically synthesized
aguagucaaaaucacuuag

SEQ ID NO: 1661 - RNA, 19 nt, artificial
  Chemically synthesized
aaaacucaaaugggcuucu

SEQ ID NO: 1662 - RNA, 19 nt, artificial
  Chemically synthesized
aacucaaaugggcuucuac

SEQ ID NO: 1663 - RNA, 19 nt, artificial
  Chemically synthesized
cucaaaugggcuucuacuu

SEQ ID NO: 1664 - RNA, 19 nt, artificial
  Chemically synthesized
aaaugggcuucuacuuuug

SEQ ID NO: 1665 - RNA, 19 nt, artificial
  Chemically synthesized
caaaaucacuuagcaggcu

SEQ ID NO: 1666 - RNA, 19 nt, artificial
  Chemically synthesized
gcuucuacuuuugcuuacc

SEQ ID NO: 1667 - RNA, 19 nt, artificial
  Chemically synthesized
cuucuacuuuugcuuaccu

SEQ ID NO: 1668 - RNA, 19 nt, artificial
  Chemically synthesized
cuuuugcuuaccuauucca

SEQ ID NO: 1669 - RNA, 19 nt, artificial
  Chemically synthesized
uuuugcuuaccuauuccau

SEQ ID NO: 1670 - RNA, 19 nt, artificial
  Chemically synthesized
ccuauuccaucccauucaa

SEQ ID NO: 1671 - RNA, 19 nt, artificial
  Chemically synthesized
aaaucacuuagcaggcucu

SEQ ID NO: 1672 - RNA, 19 nt, artificial
  Chemically synthesized
aaaaugggaucuaugcaga

SEQ ID NO: 1673 - RNA, 19 nt, artificial
  Chemically synthesized
acuucuccaaaggccagaa

SEQ ID NO: 1674 - RNA, 19 nt, artificial
  Chemically synthesized
ugaaugugaaacacagaaa

SEQ ID NO: 1675 - RNA, 19 nt, artificial
  Chemically synthesized
cagaaagaaaagagacuac

SEQ ID NO: 1676 - RNA, 19 nt, artificial
  Chemically synthesized
agacuacauuugggguuuc

SEQ ID NO: 1677 - RNA, 19 nt, artificial
  Chemically synthesized
agcugaauaguuuuacuac

SEQ ID NO: 1678 - RNA, 19 nt, artificial
  Chemically synthesized
gcugaauaguuuuacuacc

SEQ ID NO: 1679 - RNA, 19 nt, artificial
  Chemically synthesized
aaucacuguuguuccaauc

SEQ ID NO: 1680 - RNA, 19 nt, artificial
  Chemically synthesized
uuguuccaaucagugagua

SEQ ID NO: 1681 - RNA, 19 nt, artificial
  Chemically synthesized
uucuuaacaagucgaaauc

SEQ ID NO: 1682 - RNA, 19 nt, artificial
  Chemically synthesized
cuuaacaagucgaaauccu

SEQ ID NO: 1683 - RNA, 19 nt, artificial
  Chemically synthesized
aggaucagaguucuccuga

SEQ ID NO: 1684 - RNA, 19 nt, artificial
  Chemically synthesized
aagucccugaagcuagucc

SEQ ID NO: 1685 - RNA, 19 nt, artificial
  Chemically synthesized
ccugaagcuaguccaugag

SEQ ID NO: 1686 - RNA, 19 nt, artificial
  Chemically synthesized
uaguccaugagcaguucuc

SEQ ID NO: 1687 - RNA, 19 nt, artificial
  Chemically synthesized
aguccaugagcaguucucc

SEQ ID NO: 1688 - RNA, 19 nt, artificial
  Chemically synthesized
uccaugagcaguucuccug

SEQ ID NO: 1689 - RNA, 19 nt, artificial
  Chemically synthesized
cuuaaacacaaguguaagc

SEQ ID NO: 1690 - RNA, 19 nt, artificial
  Chemically synthesized
cuagaaucacacacaaucc

SEQ ID NO: 1691 - RNA, 19 nt, artificial
  Chemically synthesized
aucacacacaauccuaucc

SEQ ID NO: 1692 - RNA, 19 nt, artificial
  Chemically synthesized
caaacugccaguugcaacc

SEQ ID NO: 1693 - RNA, 19 nt, artificial
  Chemically synthesized
cuuugagcaaccaaguuua

SEQ ID NO: 1694 - RNA, 19 nt, artificial
  Chemically synthesized
uaacagccuuccauaagcc

SEQ ID NO: 1695 - RNA, 19 nt, artificial
  Chemically synthesized
ccauaagccaucaccauuu

SEQ ID NO: 1696 - RNA, 19 nt, artificial
  Chemically synthesized
aagcauaacaggcaagaga

SEQ ID NO: 1697 - RNA, 19 nt, artificial
  Chemically synthesized
cuacaucgaugcccaagaa

SEQ ID NO: 1698 - RNA, 19 nt, artificial
  Chemically synthesized
cagugaaccuuuggagcuu

SEQ ID NO: 1699 - RNA, 19 nt, artificial
  Chemically synthesized
uuuggagcuuaacaauaga

SEQ ID NO: 1700 - RNA, 19 nt, artificial
  Chemically synthesized
cauugauuuaucuuggccc

SEQ ID NO: 1701 - RNA, 19 nt, artificial
  Chemically synthesized
uuaucuuggcccaauucua

SEQ ID NO: 1702 - RNA, 19 nt, artificial
  Chemically synthesized
ggcuuuguaguaucuuucc

SEQ ID NO: 1703 - RNA, 19 nt, artificial
  Chemically synthesized
uaucuuuccaagcauuuga

SEQ ID NO: 1704 - RNA, 19 nt, artificial
  Chemically synthesized
acaccuguuuuucaguaac

SEQ ID NO: 1705 - RNA, 19 nt, artificial
  Chemically synthesized
aacaccaggaugaauacau

SEQ ID NO: 1706 - RNA, 19 nt, artificial
  Chemically synthesized
accaggaugaauacaucug

SEQ ID NO: 1707 - RNA, 19 nt, artificial
  Chemically synthesized
ggagcuaauagcuagggca

SEQ ID NO: 1708 - RNA, 19 nt, artificial
  Chemically synthesized
aggaaaccugaauaagcuc

SEQ ID NO: 1709 - RNA, 19 nt, artificial
  Chemically synthesized
ggaaaccugaauaagcucc

SEQ ID NO: 1710 - RNA, 19 nt, artificial
  Chemically synthesized
acccacagcaaggauauga

SEQ ID NO: 1711 - RNA, 19 nt, artificial
  Chemically synthesized
aagccuugcugaauugaac

SEQ ID NO: 1712 - RNA, 19 nt, artificial
  Chemically synthesized
gcugaauugaacauuguug

SEQ ID NO: 1713 - RNA, 19 nt, artificial
  Chemically synthesized
uacuuaguuggaauaagac

SEQ ID NO: 1714 - RNA, 19 nt, artificial
  Chemically synthesized
ggccuuuauuauucccuag

SEQ ID NO: 1715 - RNA, 19 nt, artificial
  Chemically synthesized
cugggugcaugcaugguua

SEQ ID NO: 1716 - RNA, 19 nt, artificial
  Chemically synthesized
ggugcaugcaugguuaucu

SEQ ID NO: 1717 - RNA, 19 nt, artificial
  Chemically synthesized
gaguuucauucucuaggcu

SEQ ID NO: 1718 - RNA, 19 nt, artificial
  Chemically synthesized
ucucuaggcuguacuauaa

SEQ ID NO: 1719 - RNA, 19 nt, artificial
  Chemically synthesized
uaaaccauaucuccauagc

SEQ ID NO: 1720 - RNA, 19 nt, artificial
  Chemically synthesized
aauugggguuaaggagaga

SEQ ID NO: 1721 - RNA, 19 nt, artificial
  Chemically synthesized
auugggguuaaggagagau

SEQ ID NO: 1722 - RNA, 19 nt, artificial
  Chemically synthesized
aauucccagaaaagcccag

SEQ ID NO: 1723 - RNA, 19 nt, artificial
  Chemically synthesized
cugccauggugaaaugguu

SEQ ID NO: 1724 - RNA, 19 nt, artificial
  Chemically synthesized
aagcacauguaauacugaa

SEQ ID NO: 1725 - RNA, 19 nt, artificial
  Chemically synthesized
uguaauacugaaaagagga

SEQ ID NO: 1726 - RNA, 19 nt, artificial
  Chemically synthesized
guaauacugaaaagaggau

SEQ ID NO: 1727 - RNA, 19 nt, artificial
  Chemically synthesized
aauacugaaaagaggauag

SEQ ID NO: 1728 - RNA, 19 nt, artificial
  Chemically synthesized
acugaaaagaggauagauu

SEQ ID NO: 1729 - RNA, 19 nt, artificial
  Chemically synthesized
ggauagauuacuaagugaa

SEQ ID NO: 1730 - RNA, 19 nt, artificial
  Chemically synthesized
ucucagaacuaauuuccua

SEQ ID NO: 1731 - RNA, 19 nt, artificial
  Chemically synthesized
cagaacuaauuuccuaucc

SEQ ID NO: 1732 - RNA, 19 nt, artificial
  Chemically synthesized
gaacuaauuuccuauccuc

SEQ ID NO: 1733 - RNA, 19 nt, artificial
  Chemically synthesized
acuaauuuccuauccucac

SEQ ID NO: 1734 - RNA, 19 nt, artificial
  Chemically synthesized
agucuauuaccaagccuac

SEQ ID NO: 1735 - RNA, 19 nt, artificial
  Chemically synthesized
gucaaaaucacuuagcagg

SEQ ID NO: 1736 - RNA, 19 nt, artificial
  Chemically synthesized
caaaaaugggaucuaugca

SEQ ID NO: 1737 - RNA, 19 nt, artificial
  Chemically synthesized
augugaaacacagaaagaa

SEQ ID NO: 1738 - RNA, 19 nt, artificial
  Chemically synthesized
agaaaagagacuacauuug

SEQ ID NO: 1739 - RNA, 19 nt, artificial
  Chemically synthesized
gagacuacauuugggguuu

SEQ ID NO: 1740 - RNA, 19 nt, artificial
  Chemically synthesized
ggguuucuuauuuagggca

SEQ ID NO: 1741 - RNA, 19 nt, artificial
  Chemically synthesized
cugacuagcugaauaguuu

SEQ ID NO: 1742 - RNA, 19 nt, artificial
  Chemically synthesized
uuuaggacccuucaaucac

SEQ ID NO: 1743 - RNA, 19 nt, artificial
  Chemically synthesized
uaacaagucgaaauccuga

SEQ ID NO: 1744 - RNA, 19 nt, artificial
  Chemically synthesized
agaggagaagcgaccucua

SEQ ID NO: 1745 - RNA, 19 nt, artificial
  Chemically synthesized
agcuaguccaugagcaguu

SEQ ID NO: 1746 - RNA, 19 nt, artificial
  Chemically synthesized
ccuuccauaagccaucacc

SEQ ID NO: 1747 - RNA, 19 nt, artificial
  Chemically synthesized
aucgaugcccaagaagccu

SEQ ID NO: 1748 - RNA, 19 nt, artificial
  Chemically synthesized
agugaaccuuuggagcuua

SEQ ID NO: 1749 - RNA, 19 nt, artificial
  Chemically synthesized
acauugauuuaucuuggcc

SEQ ID NO: 1750 - RNA, 19 nt, artificial
  Chemically synthesized
aucuuuccaagcauuugaa

SEQ ID NO: 1751 - RNA, 19 nt, artificial
  Chemically synthesized
ggaugaauacaucuguccc

SEQ ID NO: 1752 - RNA, 19 nt, artificial
  Chemically synthesized
caggaaaccugaauaagcu

SEQ ID NO: 1753 - RNA, 19 nt, artificial
  Chemically synthesized
ugaucuacuuaguuggaau

SEQ ID NO: 1754 - RNA, 19 nt, artificial
  Chemically synthesized
ucauucucuaggcuguacu

SEQ ID NO: 1755 - RNA, 19 nt, artificial
  Chemically synthesized
auucucuaggcuguacuau

SEQ ID NO: 1756 - RNA, 19 nt, artificial
  Chemically synthesized
cuaggcuguacuauaaacc

SEQ ID NO: 1757 - RNA, 19 nt, artificial
  Chemically synthesized
cuguacuauaaaccauauc

SEQ ID NO: 1758 - RNA, 19 nt, artificial
  Chemically synthesized
uacuauaaaccauaucucc

SEQ ID NO: 1759 - RNA, 19 nt, artificial
  Chemically synthesized
acccuugacaauugggguu

SEQ ID NO: 1760 - RNA, 19 nt, artificial
  Chemically synthesized
uugggguuaaggagagaua

SEQ ID NO: 1761 - RNA, 19 nt, artificial
  Chemically synthesized
ugggguuaaggagagauac

SEQ ID NO: 1762 - RNA, 19 nt, artificial
  Chemically synthesized
auucccagaaaagcccaga

SEQ ID NO: 1763 - RNA, 19 nt, artificial
  Chemically synthesized
ugccauggugaaaugguuc

SEQ ID NO: 1764 - RNA, 19 nt, artificial
  Chemically synthesized
auacugaaaagaggauaga

SEQ ID NO: 1765 - RNA, 19 nt, artificial
  Chemically synthesized
gaguaaucaacuacacaca

SEQ ID NO: 1766 - RNA, 19 nt, artificial
  Chemically synthesized
acaguauucaacacuuaag

SEQ ID NO: 1767 - RNA, 19 nt, artificial
  Chemically synthesized
caguauucaacacuuaaga

SEQ ID NO: 1768 - RNA, 19 nt, artificial
  Chemically synthesized
aaauaggcaaaucugguuu

SEQ ID NO: 1769 - RNA, 19 nt, artificial
  Chemically synthesized
ugaaucacuucuccaaagg

SEQ ID NO: 1770 - RNA, 19 nt, artificial
  Chemically synthesized
aucacuucuccaaaggcca

SEQ ID NO: 1771 - RNA, 19 nt, artificial
  Chemically synthesized
agaaagaaaagagacuaca

SEQ ID NO: 1772 - RNA, 19 nt, artificial
  Chemically synthesized
uuugggguuucuuauuuag

SEQ ID NO: 1773 - RNA, 19 nt, artificial
  Chemically synthesized
guuucuuauuuagggcagg

SEQ ID NO: 1774 - RNA, 19 nt, artificial
  Chemically synthesized
caaucagugaguaaaguuu

SEQ ID NO: 1775 - RNA, 19 nt, artificial
  Chemically synthesized
cagugaguaaaguuuuuuc

SEQ ID NO: 1776 - RNA, 19 nt, artificial
  Chemically synthesized
ucuuaacaagucgaaaucc

SEQ ID NO: 1777 - RNA, 19 nt, artificial
  Chemically synthesized
uuaacaagucgaaauccug

SEQ ID NO: 1778 - RNA, 19 nt, artificial
  Chemically synthesized
uugcugcucaaacugccag

SEQ ID NO: 1779 - RNA, 19 nt, artificial
  Chemically synthesized
ugcugcucaaacugccagu

SEQ ID NO: 1780 - RNA, 19 nt, artificial
  Chemically synthesized
agaaucacacacaauccua

SEQ ID NO: 1781 - RNA, 19 nt, artificial
  Chemically synthesized
cacacacaauccuauccag

SEQ ID NO: 1782 - RNA, 19 nt, artificial
  Chemically synthesized
ucagggacaaggaccuuug

SEQ ID NO: 1783 - RNA, 19 nt, artificial
  Chemically synthesized
acaaggaccuuugagcaac

SEQ ID NO: 1784 - RNA, 19 nt, artificial
  Chemically synthesized
ccuuugagcaaccaaguuu

SEQ ID NO: 1785 - RNA, 19 nt, artificial
  Chemically synthesized
cuuccauaagccaucacca

SEQ ID NO: 1786 - RNA, 19 nt, artificial
  Chemically synthesized
agucaguggugacaacucc

SEQ ID NO: 1787 - RNA, 19 nt, artificial
  Chemically synthesized
uugcugaauugaacauugu

SEQ ID NO: 1788 - RNA, 19 nt, artificial
  Chemically synthesized
cuggcaaguugauuccuca

SEQ ID NO: 1789 - RNA, 19 nt, artificial
  Chemically synthesized
acuauaaaccauaucucca

SEQ ID NO: 1790 - RNA, 19 nt, artificial
  Chemically synthesized
auaaaccauaucuccauag

SEQ ID NO: 1791 - RNA, 19 nt, artificial
  Chemically synthesized
cuacccuugacaauugggg

SEQ ID NO: 1792 - RNA, 19 nt, artificial
  Chemically synthesized
cccuugacaauugggguua

SEQ ID NO: 1793 - RNA, 19 nt, artificial
  Chemically synthesized
agaggauagauuacuaagu

SEQ ID NO: 1794 - RNA, 19 nt, artificial
  Chemically synthesized
gaggauagauuacuaagug

SEQ ID NO: 1795 - RNA, 19 nt, artificial
  Chemically synthesized
aucucagaacuaauuuccu

SEQ ID NO: 1796 - RNA, 19 nt, artificial
  Chemically synthesized
uagagugaggaagucacca

SEQ ID NO: 1797 - RNA, 19 nt, artificial
  Chemically synthesized
uaccaagccuaccugaaac

SEQ ID NO: 1798 - RNA, 19 nt, artificial
  Chemically synthesized
ucuacuuuugcuuaccuau

SEQ ID NO: 1799 - RNA, 19 nt, artificial
  Chemically synthesized
acccuucaaucacuguugu

SEQ ID NO: 1800 - RNA, 19 nt, artificial
  Chemically synthesized
gcuaguccaugagcaguuc

SEQ ID NO: 1801 - RNA, 19 nt, artificial
  Chemically synthesized
aguucuccugcuuaaacac

SEQ ID NO: 1802 - RNA, 19 nt, artificial
  Chemically synthesized
uucucugggucaguuucuc

SEQ ID NO: 1803 - RNA, 19 nt, artificial
  Chemically synthesized
cuugcugaauugaacauug

SEQ ID NO: 1804 - RNA, 19 nt, artificial
  Chemically synthesized
aaaccauaucuccauagcc

SEQ ID NO: 1805 - RNA, 19 nt, artificial
  Chemically synthesized
cucagaacuaauuuccuau

SEQ ID NO: 1806 - RNA, 19 nt, artificial
  Chemically synthesized
ucagaacuaauuuccuauc

SEQ ID NO: 1807 - RNA, 19 nt, artificial
  Chemically synthesized
auaggcaaaucugguuuau

SEQ ID NO: 1808 - RNA, 19 nt, artificial
  Chemically synthesized
gacccuucaaucacuguug

SEQ ID NO: 1809 - RNA, 19 nt, artificial
  Chemically synthesized
aaggaccuuugagcaacca

SEQ ID NO: 1810 - RNA, 19 nt, artificial
  Chemically synthesized
aggaccuuugagcaaccaa

SEQ ID NO: 1811 - RNA, 19 nt, artificial
  Chemically synthesized
aucaccauuuuguaagcau

SEQ ID NO: 1812 - RNA, 19 nt, artificial
  Chemically synthesized
ucaguggugacaacuccag

SEQ ID NO: 1813 - RNA, 19 nt, artificial
  Chemically synthesized
acacagugaaccuuuggag

SEQ ID NO: 1814 - RNA, 19 nt, artificial
  Chemically synthesized
auuccucaaauauuaccuc

SEQ ID NO: 1815 - RNA, 19 nt, artificial
  Chemically synthesized
uccucaaauauuaccucgu

SEQ ID NO: 1816 - RNA, 19 nt, artificial
  Chemically synthesized
ucaaauuugagucaggaac

SEQ ID NO: 1817 - RNA, 19 nt, artificial
  Chemically synthesized
auccugagcugaggaucag

SEQ ID NO: 1818 - RNA, 19 nt, artificial
  Chemically synthesized
gauuccucaaauauuaccu

SEQ ID NO: 1819 - RNA, 19 nt, artificial
  Chemically synthesized
uuccucaaauauuaccucg

SEQ ID NO: 1820 - RNA, 19 nt, artificial
  Chemically synthesized
ggcuuuuggaaguuuugau

SEQ ID NO: 1821 - RNA, 19 nt, artificial
  Chemically synthesized
gcuuuuggaaguuuugaua

SEQ ID NO: 1822 - RNA, 19 nt, artificial
  Chemically synthesized
ccaaaggccagaaaaucag

SEQ ID NO: 1823 - RNA, 19 nt, artificial
  Chemically synthesized
uccugcuuaaacacaagug

SEQ ID NO: 1824 - RNA, 19 nt, artificial
  Chemically synthesized
ucaccauuuuguaagcaua

SEQ ID NO: 1825 - RNA, 19 nt, artificial
  Chemically synthesized
aggagagauacuucaauuc

SEQ ID NO: 1826 - RNA, 19 nt, artificial
  Chemically synthesized
uucaaauuugagucaggaa

SEQ ID NO: 1827 - RNA, 19 nt, artificial
  Chemically synthesized
ccucugaaaacuuagagaa

SEQ ID NO: 1828 - RNA, 19 nt, artificial
  Chemically synthesized
accuauuccaucccauuca

SEQ ID NO: 1829 - RNA, 19 nt, artificial
  Chemically synthesized
cacuauuuugaaucacuuc

SEQ ID NO: 1830 - RNA, 19 nt, artificial
  Chemically synthesized
ccuuuuuaggacccuucaa

SEQ ID NO: 1831 - RNA, 19 nt, artificial
  Chemically synthesized
guuuuuucuuaacaagucg

SEQ ID NO: 1832 - RNA, 19 nt, artificial
  Chemically synthesized
uucuccugcuuaaacacaa

SEQ ID NO: 1833 - RNA, 19 nt, artificial
  Chemically synthesized
ccugcuuaaacacaagugu

SEQ ID NO: 1834 - RNA, 19 nt, artificial
  Chemically synthesized
ugcuuaaacacaaguguaa

SEQ ID NO: 1835 - RNA, 19 nt, artificial
  Chemically synthesized
auucucugggucaguuucu

SEQ ID NO: 1836 - RNA, 19 nt, artificial
  Chemically synthesized
ugagauaacacugccaugg

SEQ ID NO: 1837 - RNA, 19 nt, artificial
  Chemically synthesized
cuuuuuaggacccuucaau

SEQ ID NO: 1838 - RNA, 19 nt, artificial
  Chemically synthesized
uucaaucacuguuguucca

SEQ ID NO: 1839 - RNA, 19 nt, artificial
  Chemically synthesized
ugcucaaacugccaguugc

SEQ ID NO: 1840 - RNA, 19 nt, artificial
  Chemically synthesized
ugauuccucaaauauuacc

SEQ ID NO: 1841 - RNA, 19 nt, artificial
  Chemically synthesized
cucugggucaguuucucag

SEQ ID NO: 1842 - RNA, 19 nt, artificial
  Chemically synthesized
uucccagaaaagcccagag

SEQ ID NO: 1843 - RNA, 19 nt, artificial
  Chemically synthesized
ucaaucacuguuguuccaa

SEQ ID NO: 1844 - RNA, 19 nt, artificial
  Chemically synthesized
agccuuccauaagccauca

SEQ ID NO: 1845 - RNA, 19 nt, artificial
  Chemically synthesized
gccuuccauaagccaucac

SEQ ID NO: 1846 - RNA, 19 nt, artificial
  Chemically synthesized
accauaucuccauagccaa

SEQ ID NO: 1847 - RNA, 19 nt, artificial
  Chemically synthesized
aaacacagaaagaaaagag

SEQ ID NO: 1848 - RNA, 19 nt, artificial
  Chemically synthesized
cuucaaucacuguuguucc

SEQ ID NO: 1849 - RNA, 19 nt, artificial
  Chemically synthesized
ucccagaaaagcccagaga

SEQ ID NO: 1850 - RNA, 19 nt, artificial
  Chemically synthesized
aacacagaaagaaaagaga

SEQ ID NO: 1851 - RNA, 19 nt, Artificial Sequence
  Chemically synthesized
acacagaaagaaaagagac

SEQ ID NO: 1852 - RNA, 19 nt, artificial
  Chemically synthesized
caguguucuaacaaacuaa

SEQ ID NO: 1853 - RNA, 19 nt, artificial
  Chemically synthesized
ccaguguucuaacaaacua

SEQ ID NO: 1854 - RNA, 19 nt, artificial
  Chemically synthesized
ggcuuuucugggaauugaa

SEQ ID NO: 1855 - RNA, 19 nt, artificial
  Chemically synthesized
cgugaacuuggaaauugaa

SEQ ID NO: 1856 - RNA, 19 nt, artificial
  Chemically synthesized
ggauggaauagguaagcaa

SEQ ID NO: 1857 - RNA, 19 nt, artificial
  Chemically synthesized
uagccaguguucuaacaaa

SEQ ID NO: 1858 - RNA, 19 nt, artificial
  Chemically synthesized
gauugaaggguccuaaaaa

SEQ ID NO: 1859 - RNA, 19 nt, artificial
  Chemically synthesized
agaauugggccaagauaaa

SEQ ID NO: 1860 - RNA, 19 nt, artificial
  Chemically synthesized
ugcugugggucguggauaa

SEQ ID NO: 1861 - RNA, 19 nt, artificial
  Chemically synthesized
agguaagaguaaaugagaa

SEQ ID NO: 1862 - RNA, 19 nt, artificial
  Chemically synthesized
cuguccaaaucaaagcaaa

SEQ ID NO: 1863 - RNA, 19 nt, artificial
  Chemically synthesized
ucaugauuggguaguaaaa

SEQ ID NO: 1864 - RNA, 19 nt, artificial
  Chemically synthesized
gccaguguucuaacaaacu

SEQ ID NO: 1865 - RNA, 19 nt, artificial
  Chemically synthesized
gugauugaaggguccuaaa

SEQ ID NO: 1866 - RNA, 19 nt, artificial
  Chemically synthesized
ggaaggcuguuaaauuaau

SEQ ID NO: 1867 - RNA, 19 nt, artificial
  Chemically synthesized
gcuuauggaaggcuguuaa

SEQ ID NO: 1868 - RNA, 19 nt, artificial
  Chemically synthesized
uccuguuacugauacuaua

SEQ ID NO: 1869 - RNA, 19 nt, artificial
  Chemically synthesized
gguccuugucccugagaaa

SEQ ID NO: 1870 - RNA, 19 nt, artificial
  Chemically synthesized
ugguuaaaaugcuggagaa

SEQ ID NO: 1871 - RNA, 19 nt, artificial
  Chemically synthesized
ccauugagugaaugaugaa

SEQ ID NO: 1872 - RNA, 19 nt, artificial
  Chemically synthesized
caggauuucgacuuguuaa

SEQ ID NO: 1873 - RNA, 19 nt, artificial
  Chemically synthesized
acgugaacuuggaaauuga

SEQ ID NO: 1874 - RNA, 19 nt, artificial
  Chemically synthesized
gugugauccuguuacugau

SEQ ID NO: 1875 - RNA, 19 nt, artificial
  Chemically synthesized
cgagguaauauuugaggaa

SEQ ID NO: 1876 - RNA, 19 nt, artificial
  Chemically synthesized
gcuuggaaagauacuacaa

SEQ ID NO: 1877 - RNA, 19 nt, artificial
  Chemically synthesized
cuaaaaugucacuguucaa

SEQ ID NO: 1878 - RNA, 19 nt, artificial
  Chemically synthesized
gugacuuccucacucuaau

SEQ ID NO: 1879 - RNA, 19 nt, artificial
  Chemically synthesized
gccuguuaugcuuacaaaa

SEQ ID NO: 1880 - RNA, 19 nt, artificial
  Chemically synthesized
agguaggcuugguaauaga

SEQ ID NO: 1881 - RNA, 19 nt, artificial
  Chemically synthesized
gaugaauaccugugaggau

SEQ ID NO: 1882 - RNA, 19 nt, artificial
  Chemically synthesized
cugucacuagggaauaaua

SEQ ID NO: 1883 - RNA, 19 nt, artificial
  Chemically synthesized
guuuuaaagaggcaacaaa

SEQ ID NO: 1884 - RNA, 19 nt, artificial
  Chemically synthesized
guguucuaacaaacuaaac

SEQ ID NO: 1885 - RNA, 19 nt, artificial
  Chemically synthesized
gcuugguaauagacuauau

SEQ ID NO: 1886 - RNA, 19 nt, artificial
  Chemically synthesized
cauccugguguuacugaaa

SEQ ID NO: 1887 - RNA, 19 nt, artificial
  Chemically synthesized
gccuaucaaaacuuccaaa

SEQ ID NO: 1888 - RNA, 19 nt, artificial
  Chemically synthesized
uccugguguuacugaaaaa

SEQ ID NO: 1889 - RNA, 19 nt, artificial
  Chemically synthesized
ccacgguguuguuuuagau

SEQ ID NO: 1890 - RNA, 19 nt, artificial
  Chemically synthesized
gcaguuugagcagcaagaa

SEQ ID NO: 1891 - RNA, 19 nt, artificial
  Chemically synthesized
cuuggaaagauacuacaaa

SEQ ID NO: 1892 - RNA, 19 nt, artificial
  Chemically synthesized
gugugauucuagcgucgua

SEQ ID NO: 1893 - RNA, 19 nt, artificial
  Chemically synthesized
cuugggcaucgauguagaa

SEQ ID NO: 1894 - RNA, 19 nt, artificial
  Chemically synthesized
gggcuuuucugggaauuga

SEQ ID NO: 1895 - RNA, 19 nt, artificial
  Chemically synthesized
aacugucuguccaaaucaa

SEQ ID NO: 1896 - RNA, 19 nt, artificial
  Chemically synthesized
agccaguguucuaacaaac

SEQ ID NO: 1897 - RNA, 19 nt, artificial
  Chemically synthesized
gaaggguccuaaaaaggga

SEQ ID NO: 1898 - RNA, 19 nt, artificial
  Chemically synthesized
aaagcuuaacccuagguaa

SEQ ID NO: 1899 - RNA, 19 nt, artificial
  Chemically synthesized
acaugugcuuaaucucaga

SEQ ID NO: 1900 - RNA, 19 nt, artificial
  Chemically synthesized
uccucacucuaauguuuua

SEQ ID NO: 1901 - RNA, 19 nt, artificial
  Chemically synthesized
gaaagauacuacaaagcca

SEQ ID NO: 1902 - RNA, 19 nt, artificial
  Chemically synthesized
aaggguuuuuagacaggaa

SEQ ID NO: 1903 - RNA, 19 nt, artificial
  Chemically synthesized
ucauccugguguuacugaa

SEQ ID NO: 1904 - RNA, 19 nt, artificial
  Chemically synthesized
ccuguuacugauacuauaa

SEQ ID NO: 1905 - RNA, 19 nt, artificial
  Chemically synthesized
cauagaucccauuuuugua

SEQ ID NO: 1906 - RNA, 19 nt, artificial
  Chemically synthesized
aauugaaugggauggaaua

SEQ ID NO: 1907 - RNA, 19 nt, artificial
  Chemically synthesized
cugugaggauaggaaauua

SEQ ID NO: 1908 - RNA, 19 nt, artificial
  Chemically synthesized
ccuagguaagaguaaauga

SEQ ID NO: 1909 - RNA, 19 nt, artificial
  Chemically synthesized
cguggauaaggagcuuauu

SEQ ID NO: 1910 - RNA, 19 nt, artificial
  Chemically synthesized
ccagauuugccuauuuuga

SEQ ID NO: 1911 - RNA, 19 nt, artificial
  Chemically synthesized
uuggagaagugauucaaaa

SEQ ID NO: 1912 - RNA, 19 nt, artificial
  Chemically synthesized
gaggaaucaacuugccaga

SEQ ID NO: 1913 - RNA, 19 nt, artificial
  Chemically synthesized
gagaaauauuacggcaaua

SEQ ID NO: 1914 - RNA, 19 nt, artificial
  Chemically synthesized
agaauugaaugggauggaa

SEQ ID NO: 1915 - RNA, 19 nt, artificial
  Chemically synthesized
auggaauagguaagcaaaa

SEQ ID NO: 1916 - RNA, 19 nt, artificial
  Chemically synthesized
guaaaaagcuggauaggau

SEQ ID NO: 1917 - RNA, 19 nt, artificial
  Chemically synthesized
ccaccaguuccugacucaa

SEQ ID NO: 1918 - RNA, 19 nt, artificial
  Chemically synthesized
caaauuagccaguguucua

SEQ ID NO: 1919 - RNA, 19 nt, artificial
  Chemically synthesized
cucacugauuggaacaaca

SEQ ID NO: 1920 - RNA, 19 nt, artificial
  Chemically synthesized
uggagaacugucuguccaa

SEQ ID NO: 1921 - RNA, 19 nt, artificial
  Chemically synthesized
uagaauugggccaagauaa

SEQ ID NO: 1922 - RNA, 19 nt, artificial
  Chemically synthesized
cucuucaaaugcuuggaaa

SEQ ID NO: 1923 - RNA, 19 nt, artificial
  Chemically synthesized
ugugggucguggauaagga

SEQ ID NO: 1924 - RNA, 19 nt, artificial
  Chemically synthesized
ccuaaaaugucacuguuca

SEQ ID NO: 1925 - RNA, 19 nt, artificial
  Chemically synthesized
ugauugaaggguccuaaaa

SEQ ID NO: 1926 - RNA, 19 nt, artificial
  Chemically synthesized
gagaaacugacccagagaa

SEQ ID NO: 1927 - RNA, 19 nt, artificial
  Chemically synthesized
caccaguuccugacucaaa

SEQ ID NO: 1928 - RNA, 19 nt, artificial
  Chemically synthesized
caaagguccuugucccuga

SEQ ID NO: 1929 - RNA, 19 nt, artificial
  Chemically synthesized
gagugaaugaugaauaccu

SEQ ID NO: 1930 - RNA, 19 nt, artificial
  Chemically synthesized
caauaauggaacugcuuca

SEQ ID NO: 1931 - RNA, 19 nt, artificial
  Chemically synthesized
cacuaacaguuaucuuuga

SEQ ID NO: 1932 - RNA, 19 nt, artificial
  Chemically synthesized
gcgucguaccuacuuuuga

SEQ ID NO: 1933 - RNA, 19 nt, artificial
  Chemically synthesized
cggccagcauuucagaauu

SEQ ID NO: 1934 - RNA, 19 nt, artificial
  Chemically synthesized
gugcuuaaucucagaugaa

SEQ ID NO: 1935 - RNA, 19 nt, artificial
  Chemically synthesized
guuguguuaugcacgugaa

SEQ ID NO: 1936 - RNA, 19 nt, artificial
  Chemically synthesized
aguacagccuagagaauga

SEQ ID NO: 1937 - RNA, 19 nt, artificial
  Chemically synthesized
acugucuguccaaaucaaa

SEQ ID NO: 1938 - RNA, 19 nt, artificial
  Chemically synthesized
agcuuacacuuguguuuaa

SEQ ID NO: 1939 - RNA, 19 nt, artificial
  Chemically synthesized
gauuggguaguaaaacuau

SEQ ID NO: 1940 - RNA, 19 nt, artificial
  Chemically synthesized
gugaacuuggaaauugaaa

SEQ ID NO: 1941 - RNA, 19 nt, artificial
  Chemically synthesized
gccagaauuugguuaaaau

SEQ ID NO: 1942 - RNA, 19 nt, artificial
  Chemically synthesized
cuggcaguuugagcagcaa

SEQ ID NO: 1943 - RNA, 19 nt, artificial
  Chemically synthesized
gaauugaaugggauggaau

SEQ ID NO: 1944 - RNA, 19 nt, artificial
  Chemically synthesized
gucacuagggaauaauaaa

SEQ ID NO: 1945 - RNA, 19 nt, artificial
  Chemically synthesized
agaucuagucccucucuga

SEQ ID NO: 1946 - RNA, 19 nt, artificial
  Chemically synthesized
ucuugggcaucgauguaga

SEQ ID NO: 1947 - RNA, 19 nt, artificial
  Chemically synthesized
ccagagaauugcucaagau

SEQ ID NO: 1948 - RNA, 19 nt, artificial
  Chemically synthesized
cccuguucuuaaguguuga

SEQ ID NO: 1949 - RNA, 19 nt, artificial
  Chemically synthesized
gacccagagaauugcucaa

SEQ ID NO: 1950 - RNA, 19 nt, artificial
  Chemically synthesized
uuuggagaagugauucaaa

SEQ ID NO: 1951 - RNA, 19 nt, artificial
  Chemically synthesized
gugaaugaugaauaccugu

SEQ ID NO: 1952 - RNA, 19 nt, artificial
  Chemically synthesized
ucaggauuucgacuuguua

SEQ ID NO: 1953 - RNA, 19 nt, artificial
  Chemically synthesized
agugaaugaugaauaccug

SEQ ID NO: 1954 - RNA, 19 nt, artificial
  Chemically synthesized
gacaggaagguaggauuaa

SEQ ID NO: 1955 - RNA, 19 nt, artificial
  Chemically synthesized
ggguccuaaaaagggaaaa

SEQ ID NO: 1956 - RNA, 19 nt, artificial
  Chemically synthesized
ggauaaggagcuuauucag

SEQ ID NO: 1957 - RNA, 19 nt, artificial
  Chemically synthesized
cuuauggaaggcuguuaaa

SEQ ID NO: 1958 - RNA, 19 nt, artificial
  Chemically synthesized
cgaaggaaacagagccguu

SEQ ID NO: 1959 - RNA, 19 nt, artificial
  Chemically synthesized
guucuaacaaacuaaacuc

SEQ ID NO: 1960 - RNA, 19 nt, artificial
  Chemically synthesized
aaugggauggaauagguaa

SEQ ID NO: 1961 - RNA, 19 nt, artificial
  Chemically synthesized
ccuguucuuaaguguugaa

SEQ ID NO: 1962 - RNA, 19 nt, artificial
  Chemically synthesized
ggccuuauuuuuugucuua

SEQ ID NO: 1963 - RNA, 19 nt, artificial
  Chemically synthesized
cucucugauucacuuagua

SEQ ID NO: 1964 - RNA, 19 nt, artificial
  Chemically synthesized
ggcaguuugagcagcaaga

SEQ ID NO: 1965 - RNA, 19 nt, artificial
  Chemically synthesized
cgucguaccuacuuuugag

SEQ ID NO: 1966 - RNA, 19 nt, artificial
  Chemically synthesized
gaaugaaacucaccgucca

SEQ ID NO: 1967 - RNA, 19 nt, artificial
  Chemically synthesized
gucuauuguuaagcuccaa

SEQ ID NO: 1968 - RNA, 19 nt, artificial
  Chemically synthesized
caaccucaacgagguaaua

SEQ ID NO: 1969 - RNA, 19 nt, artificial
  Chemically synthesized
uaggcuugguaauagacua

SEQ ID NO: 1970 - RNA, 19 nt, artificial
  Chemically synthesized
guauguaaaaagcuggaua

SEQ ID NO: 1971 - RNA, 19 nt, artificial
  Chemically synthesized
guugcaacuggcaguuuga

SEQ ID NO: 1972 - RNA, 19 nt, artificial
  Chemically synthesized
ccuagagaaugaaacucac

SEQ ID NO: 1973 - RNA, 19 nt, artificial
  Chemically synthesized
gccugcuaagugauuuuga

SEQ ID NO: 1974 - RNA, 19 nt, artificial
  Chemically synthesized
cuauuagcuccacuucaca

SEQ ID NO: 1975 - RNA, 19 nt, artificial
  Chemically synthesized
agugauugaaggguccuaa

SEQ ID NO: 1976 - RNA, 19 nt, artificial
  Chemically synthesized
ggguaguagcuguauacua

SEQ ID NO: 1977 - RNA, 19 nt, artificial
  Chemically synthesized
uguuguuuugcaugucuau

SEQ ID NO: 1978 - RNA, 19 nt, artificial
  Chemically synthesized
guuccugacucaaauuuga

SEQ ID NO: 1979 - RNA, 19 nt, artificial
  Chemically synthesized
caguaaccacgguguuguu

SEQ ID NO: 1980 - RNA, 19 nt, artificial
  Chemically synthesized
agauuuuuuccaccuugga

SEQ ID NO: 1981 - RNA, 19 nt, artificial
  Chemically synthesized
cccagagaauugcucaaga

SEQ ID NO: 1982 - RNA, 19 nt, artificial
  Chemically synthesized
cagauuugccuauuuugau

SEQ ID NO: 1983 - RNA, 19 nt, artificial
  Chemically synthesized
uggaaggcuguuaaauuaa

SEQ ID NO: 1984 - RNA, 19 nt, artificial
  Chemically synthesized
uauaguacagccuagagaa

SEQ ID NO: 1985 - RNA, 19 nt, artificial
  Chemically synthesized
gguuguguuaugcacguga

SEQ ID NO: 1986 - RNA, 19 nt, artificial
  Chemically synthesized
gauaccugucacuagggaa

SEQ ID NO: 1987 - RNA, 19 nt, artificial
  Chemically synthesized
ccuaucaaaacuuccaaaa

SEQ ID NO: 1988 - RNA, 19 nt, artificial
  Chemically synthesized
gcguagggacagauguauu

SEQ ID NO: 1989 - RNA, 19 nt, artificial
  Chemically synthesized
gauacuauaagugaccuaa

SEQ ID NO: 1990 - RNA, 19 nt, artificial
  Chemically synthesized
cgaagucugcauuggcuau

SEQ ID NO: 1991 - RNA, 19 nt, artificial
  Chemically synthesized
ggauaggauugugugugau

SEQ ID NO: 1992 - RNA, 19 nt, artificial
  Chemically synthesized
ggccuuuggagaagugauu

SEQ ID NO: 1993 - RNA, 19 nt, artificial
  Chemically synthesized
auagguaagcaaaaguaga

SEQ ID NO: 1994 - RNA, 19 nt, artificial
  Chemically synthesized
gguaggauuaaguagguga

SEQ ID NO: 1995 - RNA, 19 nt, artificial
  Chemically synthesized
gauuaaguaggugaguuua

SEQ ID NO: 1996 - RNA, 19 nt, artificial
  Chemically synthesized
aggaagguaggauuaagua

SEQ ID NO: 1997 - RNA, 19 nt, artificial
  Chemically synthesized
ggugugauccuguuacuga

SEQ ID NO: 1998 - RNA, 19 nt, artificial
  Chemically synthesized
cauggacuagcuucaggga

SEQ ID NO: 1999 - RNA, 19 nt, artificial
  Chemically synthesized
gaaggguuuuuagacagga

SEQ ID NO: 2000 - RNA, 19 nt, artificial
  Chemically synthesized
cuuuggagaagugauucaa

SEQ ID NO: 2001 - RNA, 19 nt, artificial
  Chemically synthesized
uggagaagugauucaaaau

SEQ ID NO: 2002 - RNA, 19 nt, artificial
  Chemically synthesized
cagugauugaaggguccua

SEQ ID NO: 2003 - RNA, 19 nt, artificial
  Chemically synthesized
uguacagaauugaauggga

SEQ ID NO: 2004 - RNA, 19 nt, artificial
  Chemically synthesized
ucaacgagguaauauuuga

SEQ ID NO: 2005 - RNA, 19 nt, artificial
  Chemically synthesized
cucugggcuuuucugggaa

SEQ ID NO: 2006 - RNA, 19 nt, artificial
  Chemically synthesized
ggcuugcgagguuguguua

SEQ ID NO: 2007 - RNA, 19 nt, artificial
  Chemically synthesized
cggcaauaauggaacugcu

SEQ ID NO: 2008 - RNA, 19 nt, artificial
  Chemically synthesized
cuuuacucacugauuggaa

SEQ ID NO: 2009 - RNA, 19 nt, artificial
  Chemically synthesized
ggacuuuuucuuuaguaga

SEQ ID NO: 2010 - RNA, 19 nt, artificial
  Chemically synthesized
cucugauucacuuaguaau

SEQ ID NO: 2011 - RNA, 19 nt, artificial
  Chemically synthesized
guacagaauugaaugggau

SEQ ID NO: 2012 - RNA, 19 nt, artificial
  Chemically synthesized
gggaauaauaaaggccuua

SEQ ID NO: 2013 - RNA, 19 nt, artificial
  Chemically synthesized
uaccugugaggauaggaaa

SEQ ID NO: 2014 - RNA, 19 nt, artificial
  Chemically synthesized
ggauaccugucacuaggga

SEQ ID NO: 2015 - RNA, 19 nt, artificial
  Chemically synthesized
cuagcuucagggacuuuuu

SEQ ID NO: 2016 - RNA, 19 nt, artificial
  Chemically synthesized
aaagauacuacaaagccaa

SEQ ID NO: 2017 - RNA, 19 nt, artificial
  Chemically synthesized
uguggugccauuucaguaa

SEQ ID NO: 2018 - RNA, 19 nt, artificial
  Chemically synthesized
auagaauugggccaagaua

SEQ ID NO: 2019 - RNA, 19 nt, artificial
  Chemically synthesized
guuucagguaggcuuggua

SEQ ID NO: 2020 - RNA, 19 nt, artificial
  Chemically synthesized
ggucguggauaaggagcuu

SEQ ID NO: 2021 - RNA, 19 nt, artificial
  Chemically synthesized
aauggugauggcuuaugga

SEQ ID NO: 2022 - RNA, 19 nt, artificial
  Chemically synthesized
gcuuguggugccauuucag

SEQ ID NO: 2023 - RNA, 19 nt, artificial
  Chemically synthesized
ugugcuuaaucucagauga

SEQ ID NO: 2024 - RNA, 19 nt, artificial
  Chemically synthesized
uagguaagcaaaaguagaa

SEQ ID NO: 2025 - RNA, 19 nt, artificial
  Chemically synthesized
ugauuuucuggccuuugga

SEQ ID NO: 2026 - RNA, 19 nt, artificial
  Chemically synthesized
gcuucuugggcaucgaugu

SEQ ID NO: 2027 - RNA, 19 nt, artificial
  Chemically synthesized
ccguccagauaaccaugca

SEQ ID NO: 2028 - RNA, 19 nt, artificial
  Chemically synthesized
aaccaugcaugcacccaga

SEQ ID NO: 2029 - RNA, 19 nt, artificial
  Chemically synthesized
caggaagguaggauuaagu

SEQ ID NO: 2030 - RNA, 19 nt, artificial
  Chemically synthesized
gaauugggccaagauaaau

SEQ ID NO: 2031 - RNA, 19 nt, artificial
  Chemically synthesized
gugaggauaggaaauuagu

SEQ ID NO: 2032 - RNA, 19 nt, artificial
  Chemically synthesized
gauuuuuuccaccuuggau

SEQ ID NO: 2033 - RNA, 19 nt, artificial
  Chemically synthesized
gcaugcacccagauuuuuu

SEQ ID NO: 2034 - RNA, 19 nt, artificial
  Chemically synthesized
ccugcuaagugauuuugac

SEQ ID NO: 2035 - RNA, 19 nt, artificial
  Chemically synthesized
gggauuauguuguuccuga

SEQ ID NO: 2036 - RNA, 19 nt, artificial
  Chemically synthesized
ugccuguuaugcuuacaaa

SEQ ID NO: 2037 - RNA, 19 nt, artificial
  Chemically synthesized
ccaccuuggauaccuguca

SEQ ID NO: 2038 - RNA, 19 nt, artificial
  Chemically synthesized
uggccuuuggagaagugau

SEQ ID NO: 2039 - RNA, 19 nt, artificial
  Chemically synthesized
cugcauagaucccauuuuu

SEQ ID NO: 2040 - RNA, 19 nt, artificial
  Chemically synthesized
ccaaccucaacgagguaau

SEQ ID NO: 2041 - RNA, 19 nt, artificial
  Chemically synthesized
agaaacugacccagagaau

SEQ ID NO: 2042 - RNA, 19 nt, artificial
  Chemically synthesized
uggugacuuccucacucua

SEQ ID NO: 2043 - RNA, 19 nt, artificial
  Chemically synthesized
agggaauaauaaaggccuu

SEQ ID NO: 2044 - RNA, 19 nt, artificial
  Chemically synthesized
ccuguuaugcuuacaaaau

SEQ ID NO: 2045 - RNA, 19 nt, artificial
  Chemically synthesized
aaaguagaagcccauuuga

SEQ ID NO: 2046 - RNA, 19 nt, artificial
  Chemically synthesized
gauuuugacuacugggauu

SEQ ID NO: 2047 - RNA, 19 nt, artificial
  Chemically synthesized
ggcuuauggaaggcuguua

SEQ ID NO: 2048 - RNA, 19 nt, artificial
  Chemically synthesized
uguuguccuuuuuccacua

SEQ ID NO: 2049 - RNA, 19 nt, artificial
  Chemically synthesized
ggcguagggacagauguau

SEQ ID NO: 2050 - RNA, 19 nt, artificial
  Chemically synthesized
aguguagauuuucugcaua

SEQ ID NO: 2051 - RNA, 19 nt, artificial
  Chemically synthesized
ccuuggauaccugucacua

SEQ ID NO: 2052 - RNA, 19 nt, artificial
  Chemically synthesized
ccagauuuuuuccaccuug

SEQ ID NO: 2053 - RNA, 19 nt, artificial
  Chemically synthesized
uagguaagaguaaaugaga

SEQ ID NO: 2054 - RNA, 19 nt, artificial
  Chemically synthesized
accugcccuaaauaagaaa

SEQ ID NO: 2055 - RNA, 19 nt, artificial
  Chemically synthesized
ugaggauaggaaauuaguu

SEQ ID NO: 2056 - RNA, 19 nt, artificial
  Chemically synthesized
ggcuuuuuuuucucuaagu

SEQ ID NO: 2057 - RNA, 19 nt, artificial
  Chemically synthesized
aaggguccuaaaaagggaa

SEQ ID NO: 2058 - RNA, 19 nt, artificial
  Chemically synthesized
uaugcacgugaacuuggaa

SEQ ID NO: 2059 - RNA, 19 nt, artificial
  Chemically synthesized
ggcuugguaauagacuaua

SEQ ID NO: 2060 - RNA, 19 nt, artificial
  Chemically synthesized
cguugaccaugguugcaac

SEQ ID NO: 2061 - RNA, 19 nt, artificial
  Chemically synthesized
ugucuauuguuaagcucca

SEQ ID NO: 2062 - RNA, 19 nt, artificial
  Chemically synthesized
gcauagaucccauuuuugu

SEQ ID NO: 2063 - RNA, 19 nt, artificial
  Chemically synthesized
caauuuacgaagucugcau

SEQ ID NO: 2064 - RNA, 19 nt, artificial
  Chemically synthesized
ggaauagguaagcaaaagu

SEQ ID NO: 2065 - RNA, 19 nt, artificial
  Chemically synthesized
ucagcuaaagucauuugua

SEQ ID NO: 2066 - RNA, 19 nt, artificial
  Chemically synthesized
gcuggauaggauugugugu

SEQ ID NO: 2067 - RNA, 19 nt, artificial
  Chemically synthesized
ggaagguaggauuaaguag

SEQ ID NO: 2068 - RNA, 19 nt, artificial
  Chemically synthesized
guacagccuagagaaugaa

SEQ ID NO: 2069 - RNA, 19 nt, artificial
  Chemically synthesized
gauucuagcgucguaccua

SEQ ID NO: 2070 - RNA, 19 nt, artificial
  Chemically synthesized
gaucuagucccucucugau

SEQ ID NO: 2071 - RNA, 19 nt, artificial
  Chemically synthesized
gacucaaauuugaaggguu

SEQ ID NO: 2072 - RNA, 19 nt, artificial
  Chemically synthesized
uccacucaacaauguucaa

SEQ ID NO: 2073 - RNA, 19 nt, artificial
  Chemically synthesized
uguagauuuucugcauaga

SEQ ID NO: 2074 - RNA, 19 nt, artificial
  Chemically synthesized
ucguggauaaggagcuuau

SEQ ID NO: 2075 - RNA, 19 nt, artificial
  Chemically synthesized
uggagauaugguuuauagu

SEQ ID NO: 2076 - RNA, 19 nt, artificial
  Chemically synthesized
guauacuaccacuuugaau

SEQ ID NO: 2077 - RNA, 19 nt, artificial
  Chemically synthesized
ccguugaccaugguugcaa

SEQ ID NO: 2078 - RNA, 19 nt, artificial
  Chemically synthesized
gggauggaauagguaagca

SEQ ID NO: 2079 - RNA, 19 nt, artificial
  Chemically synthesized
gaauuauugaaacggguca

SEQ ID NO: 2080 - RNA, 19 nt, artificial
  Chemically synthesized
cuauggagauaugguuuau

SEQ ID NO: 2081 - RNA, 19 nt, artificial
  Chemically synthesized
ccuuuggagaagugauuca

SEQ ID NO: 2082 - RNA, 19 nt, artificial
  Chemically synthesized
agcccauuugaguuuuaca

SEQ ID NO: 2083 - RNA, 19 nt, artificial
  Chemically synthesized
aggauugugugugauucua

SEQ ID NO: 2084 - RNA, 19 nt, artificial
  Chemically synthesized
ugcuuggaaagauacuaca

SEQ ID NO: 2085 - RNA, 19 nt, artificial
  Chemically synthesized
accaguuccugacucaaau

SEQ ID NO: 2086 - RNA, 19 nt, artificial
  Chemically synthesized
ggcuauggagauaugguuu

SEQ ID NO: 2087 - RNA, 19 nt, artificial
  Chemically synthesized
cuuuuuccacuaacaguua

SEQ ID NO: 2088 - RNA, 19 nt, artificial
  Chemically synthesized
cccagauuuuuuccaccuu

SEQ ID NO: 2089 - RNA, 19 nt, artificial
  Chemically synthesized
gguccuaaaaagggaaaau

SEQ ID NO: 2090 - RNA, 19 nt, artificial
  Chemically synthesized
gcuucagggacuuuuucuu

SEQ ID NO: 2091 - RNA, 19 nt, artificial
  Chemically synthesized
uguuuuaaagaggcaacaa

SEQ ID NO: 2092 - RNA, 19 nt, artificial
  Chemically synthesized
ggaauaauaaaggccuuau

SEQ ID NO: 2093 - RNA, 19 nt, artificial
  Chemically synthesized
gcaugucuauuguuaagcu

SEQ ID NO: 2094 - RNA, 19 nt, artificial
  Chemically synthesized
agguccuugucccugagaa

SEQ ID NO: 2095 - RNA, 19 nt, artificial
  Chemically synthesized
ugaugaauaccugugagga

SEQ ID NO: 2096 - RNA, 19 nt, artificial
  Chemically synthesized
cuguauacuaccacuuuga

SEQ ID NO: 2097 - RNA, 19 nt, artificial
  Chemically synthesized
guagauuuucugcauagau

SEQ ID NO: 2098 - RNA, 19 nt, artificial
  Chemically synthesized
uuaugcacgugaacuugga

SEQ ID NO: 2099 - RNA, 19 nt, artificial
  Chemically synthesized
gaaacugacccagagaauu

SEQ ID NO: 2100 - RNA, 19 nt, artificial
  Chemically synthesized
ccaguuccugacucaaauu

SEQ ID NO: 2101 - RNA, 19 nt, artificial
  Chemically synthesized
gaaacagagccguugacca

SEQ ID NO: 2102 - RNA, 19 nt, artificial
  Chemically synthesized
gagaacugucuguccaaau

SEQ ID NO: 2103 - RNA, 19 nt, artificial
  Chemically synthesized
ugucacuagggaauaauaa

SEQ ID NO: 2104 - RNA, 19 nt, artificial
  Chemically synthesized
cauugagugaaugaugaau

SEQ ID NO: 2105 - RNA, 19 nt, artificial
  Chemically synthesized
uacagccuagagaaugaaa

SEQ ID NO: 2106 - RNA, 19 nt, artificial
  Chemically synthesized
ggagaacucugauccucag

SEQ ID NO: 2107 - RNA, 19 nt, artificial
  Chemically synthesized
acgagguaauauuugagga

SEQ ID NO: 2108 - RNA, 19 nt, artificial
  Chemically synthesized
cagggacuuuuucuuuagu

SEQ ID NO: 2109 - RNA, 19 nt, artificial
  Chemically synthesized
aguugauuacucuuccauu

SEQ ID NO: 2110 - RNA, 19 nt, artificial
  Chemically synthesized
ggaacaacagugauugaag

SEQ ID NO: 2111 - RNA, 19 nt, artificial
  Chemically synthesized
aaggaaacagagccguuga

SEQ ID NO: 2112 - RNA, 19 nt, artificial
  Chemically synthesized
caaagccaaucuuuauaga

SEQ ID NO: 2113 - RNA, 19 nt, artificial
  Chemically synthesized
aaacgggucaauuuacgaa

SEQ ID NO: 2114 - RNA, 19 nt, artificial
  Chemically synthesized
aaggcuucuugggcaucga

SEQ ID NO: 2115 - RNA, 19 nt, artificial
  Chemically synthesized
ccugagaaacugacccaga

SEQ ID NO: 2116 - RNA, 19 nt, artificial
  Chemically synthesized
cugcauuggcuauggagau

SEQ ID NO: 2117 - RNA, 19 nt, artificial
  Chemically synthesized
gauugugugugauucuagc

SEQ ID NO: 2118 - RNA, 19 nt, artificial
  Chemically synthesized
gcuagucagcuaaagucau

SEQ ID NO: 2119 - RNA, 19 nt, artificial
  Chemically synthesized
uauucauccugguguuacu

SEQ ID NO: 2120 - RNA, 19 nt, artificial
  Chemically synthesized
ggguaguaaaacuauucag

SEQ ID NO: 2121 - RNA, 19 nt, artificial
  Chemically synthesized
accacgguguuguuuuaga

SEQ ID NO: 2122 - RNA, 19 nt, artificial
  Chemically synthesized
caguuaucuuugacucucu

SEQ ID NO: 2123 - RNA, 19 nt, artificial
  Chemically synthesized
cacaauuugguuucaggua

SEQ ID NO: 2124 - RNA, 19 nt, artificial
  Chemically synthesized
ugauuggguaguaaaacua

SEQ ID NO: 2125 - RNA, 19 nt, artificial
  Chemically synthesized
cuucuugggcaucgaugua

SEQ ID NO: 2126 - RNA, 19 nt, artificial
  Chemically synthesized
gcuuuucugggaauugaag

SEQ ID NO: 2127 - RNA, 19 nt, artificial
  Chemically synthesized
ggauugugugugauucuag

SEQ ID NO: 2128 - RNA, 19 nt, artificial
  Chemically synthesized
agucugcauuggcuaugga

SEQ ID NO: 2129 - RNA, 19 nt, artificial
  Chemically synthesized
acuacaaagccaaucuuua

SEQ ID NO: 2130 - RNA, 19 nt, artificial
  Chemically synthesized
uaguguagauuuucugcau

SEQ ID NO: 2131 - RNA, 19 nt, artificial
  Chemically synthesized
gcaaaaguagaagcccauu

SEQ ID NO: 2132 - RNA, 19 nt, artificial
  Chemically synthesized
gggucaauuuacgaagucu

SEQ ID NO: 2133 - RNA, 19 nt, artificial
  Chemically synthesized
aggcuucuugggcaucgau

SEQ ID NO: 2134 - RNA, 19 nt, artificial
  Chemically synthesized
ugauuggaacaacagugau

SEQ ID NO: 2135 - RNA, 19 nt, artificial
  Chemically synthesized
aauucagcaaggcuuucau

SEQ ID NO: 2136 - RNA, 19 nt, artificial
  Chemically synthesized
aaugaugaauaccugugag

SEQ ID NO: 2137 - RNA, 19 nt, artificial
  Chemically synthesized
auaccugugaggauaggaa

SEQ ID NO: 2138 - RNA, 19 nt, artificial
  Chemically synthesized
uucaugauuggguaguaaa

SEQ ID NO: 2139 - RNA, 19 nt, artificial
  Chemically synthesized
cuacaaagccaaucuuuau

SEQ ID NO: 2140 - RNA, 19 nt, artificial
  Chemically synthesized
gagccugcuaagugauuuu

SEQ ID NO: 2141 - RNA, 19 nt, artificial
  Chemically synthesized
aacccuagguaagaguaaa

SEQ ID NO: 2142 - RNA, 19 nt, artificial
  Chemically synthesized
uaacccuagguaagaguaa

SEQ ID NO: 2143 - RNA, 19 nt, artificial
  Chemically synthesized
caaaauggugauggcuuau

SEQ ID NO: 2144 - RNA, 19 nt, artificial
  Chemically synthesized
uuagccaguguucuaacaa

SEQ ID NO: 2145 - RNA, 19 nt, artificial
  Chemically synthesized
aacuguuguccuuuuucca

SEQ ID NO: 2146 - RNA, 19 nt, artificial
  Chemically synthesized
gcauuucagaauugcugga

SEQ ID NO: 2147 - RNA, 19 nt, artificial
  Chemically synthesized
guaccuacuuuugagcuua

SEQ ID NO: 2148 - RNA, 19 nt, artificial
  Chemically synthesized
cugucuguccaaaucaaag

SEQ ID NO: 2149 - RNA, 19 nt, artificial
  Chemically synthesized
gucuuauuccaacuaagua

SEQ ID NO: 2150 - RNA, 19 nt, artificial
  Chemically synthesized
uuguguuuaagcaggagaa

SEQ ID NO: 2151 - RNA, 19 nt, artificial
  Chemically synthesized
ugccagaauuugguuaaaa

SEQ ID NO: 2152 - RNA, 19 nt, artificial
  Chemically synthesized
cuaauguuuuaaagaggca

SEQ ID NO: 2153 - RNA, 19 nt, artificial
  Chemically synthesized
cuaaguuuucagaggauuu

SEQ ID NO: 2154 - RNA, 19 nt, artificial
  Chemically synthesized
gguuuauaguacagccuag

SEQ ID NO: 2155 - RNA, 19 nt, artificial
  Chemically synthesized
acaggaagguaggauuaag

SEQ ID NO: 2156 - RNA, 19 nt, artificial
  Chemically synthesized
uccucugguuucaggagaa

SEQ ID NO: 2157 - RNA, 19 nt, artificial
  Chemically synthesized
uguuguuuuagaugccuuu

SEQ ID NO: 2158 - RNA, 19 nt, artificial
  Chemically synthesized
ucucugauucacuuaguaa

SEQ ID NO: 2159 - RNA, 19 nt, artificial
  Chemically synthesized
ugauuuugacuacugggau

SEQ ID NO: 2160 - RNA, 19 nt, artificial
  Chemically synthesized
agagagccugcuaagugau

SEQ ID NO: 2161 - RNA, 19 nt, artificial
  Chemically synthesized
ggugauggcuuauggaagg

SEQ ID NO: 2162 - RNA, 19 nt, artificial
  Chemically synthesized
ugucaaggguaguagcugu

SEQ ID NO: 2163 - RNA, 19 nt, artificial
  Chemically synthesized
cgcuucuccucugguuuca

SEQ ID NO: 2164 - RNA, 19 nt, artificial
  Chemically synthesized
auguuguuuugcaugucua

SEQ ID NO: 2165 - RNA, 19 nt, artificial
  Chemically synthesized
cuagcgucguaccuacuuu

SEQ ID NO: 2166 - RNA, 19 nt, artificial
  Chemically synthesized
ccagauaaccaugcaugca

SEQ ID NO: 2167 - RNA, 19 nt, artificial
  Chemically synthesized
cuuccaaaagcccacacca

SEQ ID NO: 2168 - RNA, 19 nt, artificial
  Chemically synthesized
aguuaucuuugacucucuu

SEQ ID NO: 2169 - RNA, 19 nt, artificial
  Chemically synthesized
cuuaaguguugaauacugu

SEQ ID NO: 2170 - RNA, 19 nt, artificial
  Chemically synthesized
cauagcaacugcagcuaac

SEQ ID NO: 2171 - RNA, 19 nt, artificial
  Chemically synthesized
ccggccagcauuucagaau

SEQ ID NO: 2172 - RNA, 19 nt, artificial
  Chemically synthesized
ggccaagauaaaucaaugu

SEQ ID NO: 2173 - RNA, 19 nt, artificial
  Chemically synthesized
auauuacggcaauaaugga

SEQ ID NO: 2174 - RNA, 19 nt, artificial
  Chemically synthesized
acuuccucacucuaauguu

SEQ ID NO: 2175 - RNA, 19 nt, artificial
  Chemically synthesized
uaaaaagcuggauaggauu

SEQ ID NO: 2176 - RNA, 19 nt, artificial
  Chemically synthesized
auguuguuccugaacccaa

SEQ ID NO: 2177 - RNA, 19 nt, artificial
  Chemically synthesized
gguuucaggagaacucuga

SEQ ID NO: 2178 - RNA, 19 nt, artificial
  Chemically synthesized
caugguugcaacuggcagu

SEQ ID NO: 2179 - RNA, 19 nt, artificial
  Chemically synthesized
uuucagguaggcuugguaa

SEQ ID NO: 2180 - RNA, 19 nt, artificial
  Chemically synthesized
ugugauccuguuacugaua

SEQ ID NO: 2181 - RNA, 19 nt, artificial
  Chemically synthesized
uuucaugauuggguaguaa

SEQ ID NO: 2182 - RNA, 19 nt, artificial
  Chemically synthesized
guuuuuagacaggaaggua

SEQ ID NO: 2183 - RNA, 19 nt, artificial
  Chemically synthesized
agguuuccugcccuagcua

SEQ ID NO: 2184 - RNA, 19 nt, artificial
  Chemically synthesized
caacaauguucaauucagc

SEQ ID NO: 2185 - RNA, 19 nt, artificial
  Chemically synthesized
ccucuuuucaguauuacau

SEQ ID NO: 2186 - RNA, 19 nt, artificial
  Chemically synthesized
gucaaggguaguagcugua

SEQ ID NO: 2187 - RNA, 19 nt, artificial
  Chemically synthesized
aguguugaauacugucuuu

SEQ ID NO: 2188 - RNA, 19 nt, artificial
  Chemically synthesized
gaacaacagugauugaagg

SEQ ID NO: 2189 - RNA, 19 nt, artificial
  Chemically synthesized
uccucuuuucaguauuaca

SEQ ID NO: 2190 - RNA, 19 nt, artificial
  Chemically synthesized
aggaaucaacuugccagaa

SEQ ID NO: 2191 - RNA, 19 nt, artificial
  Chemically synthesized
cguccagauaaccaugcau

SEQ ID NO: 2192 - RNA, 19 nt, artificial
  Chemically synthesized
ccuuuuuccacuaacaguu

SEQ ID NO: 2193 - RNA, 19 nt, artificial
  Chemically synthesized
cagaauugaaugggaugga

SEQ ID NO: 2194 - RNA, 19 nt, artificial
  Chemically synthesized
uuuucuggccuuuggagaa

SEQ ID NO: 2195 - RNA, 19 nt, artificial
  Chemically synthesized
ccucucugauucacuuagu

SEQ ID NO: 2196 - RNA, 19 nt, artificial
  Chemically synthesized
gucccucucugauucacuu

SEQ ID NO: 2197 - RNA, 19 nt, artificial
  Chemically synthesized
aggguccuaaaaagggaaa

SEQ ID NO: 2198 - RNA, 19 nt, artificial
  Chemically synthesized
uauagaauugggccaagau

SEQ ID NO: 2199 - RNA, 19 nt, artificial
  Chemically synthesized
guuucaggagaacucugau

SEQ ID NO: 2200 - RNA, 19 nt, artificial
  Chemically synthesized
gcuauuagcuccacuucac

SEQ ID NO: 2201 - RNA, 19 nt, artificial
  Chemically synthesized
ugggccaagauaaaucaau

SEQ ID NO: 2202 - RNA, 19 nt, artificial
  Chemically synthesized
acucaaauuugaaggguuu

SEQ ID NO: 2203 - RNA, 19 nt, artificial
  Chemically synthesized
cuaacaggcugauuuucug

SEQ ID NO: 2204 - RNA, 19 nt, artificial
  Chemically synthesized
caauguucaauucagcaag

SEQ ID NO: 2205 - RNA, 19 nt, artificial
  Chemically synthesized
ugguguuacugaaaaacag

SEQ ID NO: 2206 - RNA, 19 nt, artificial
  Chemically synthesized
guuccugaacccaaccuca

SEQ ID NO: 2207 - RNA, 19 nt, artificial
  Chemically synthesized
aggagaacucugauccuca

SEQ ID NO: 2208 - RNA, 19 nt, artificial
  Chemically synthesized
uugccagaauuugguuaaa

SEQ ID NO: 2209 - RNA, 19 nt, artificial
  Chemically synthesized
uguauacuaccacuuugaa

SEQ ID NO: 2210 - RNA, 19 nt, artificial
  Chemically synthesized
auccugguguuacugaaaa

SEQ ID NO: 2211 - RNA, 19 nt, artificial
  Chemically synthesized
cagcuaacaggcugauuuu

SEQ ID NO: 2212 - RNA, 19 nt, artificial
  Chemically synthesized
cccaaauguagucucuuuu

SEQ ID NO: 2213 - RNA, 19 nt, artificial
  Chemically synthesized
ccaugcaugcacccagauu

SEQ ID NO: 2214 - RNA, 19 nt, artificial
  Chemically synthesized
auggugauggcuuauggaa

SEQ ID NO: 2215 - RNA, 19 nt, artificial
  Chemically synthesized
gaaccauuucaccauggca

SEQ ID NO: 2216 - RNA, 19 nt, artificial
  Chemically synthesized
acuaaacuugguugcucaa

SEQ ID NO: 2217 - RNA, 19 nt, artificial
  Chemically synthesized
uuuucugcauagaucccau

SEQ ID NO: 2218 - RNA, 19 nt, artificial
  Chemically synthesized
acgaagucugcauuggcua

SEQ ID NO: 2219 - RNA, 19 nt, artificial
  Chemically synthesized
gaucauuaucucuuuccuu

SEQ ID NO: 2220 - RNA, 19 nt, artificial
  Chemically synthesized
uggcuauggagauaugguu

SEQ ID NO: 2221 - RNA, 19 nt, artificial
  Chemically synthesized
gguaguagcuguauacuac

SEQ ID NO: 2222 - RNA, 19 nt, artificial
  Chemically synthesized
uugggccaagauaaaucaa

SEQ ID NO: 2223 - RNA, 19 nt, artificial
  Chemically synthesized
ccaauugucaaggguagua

SEQ ID NO: 2224 - RNA, 19 nt, artificial
  Chemically synthesized
cuuaguaaucuauccucuu

SEQ ID NO: 2225 - RNA, 19 nt, artificial
  Chemically synthesized
uggugauggcuuauggaag

SEQ ID NO: 2226 - RNA, 19 nt, artificial
  Chemically synthesized
cuggaguugucaccacuga

SEQ ID NO: 2227 - RNA, 19 nt, artificial
  Chemically synthesized
cacugauuggaacaacagu

SEQ ID NO: 2228 - RNA, 19 nt, artificial
  Chemically synthesized
caguuugagcagcaagaac

SEQ ID NO: 2229 - RNA, 19 nt, artificial
  Chemically synthesized
uagggacagauguauucau

SEQ ID NO: 2230 - RNA, 19 nt, artificial
  Chemically synthesized
caaucuuuauagaauuggg

SEQ ID NO: 2231 - RNA, 19 nt, artificial
  Chemically synthesized
uguccuuuuuccacuaaca

SEQ ID NO: 2232 - RNA, 19 nt, artificial
  Chemically synthesized
guccuaaaaagggaaaaua

SEQ ID NO: 2233 - RNA, 19 nt, artificial
  Chemically synthesized
gguugcaacuggcaguuug

SEQ ID NO: 2234 - RNA, 19 nt, artificial
  Chemically synthesized
agccuaucaaaacuuccaa

SEQ ID NO: 2235 - RNA, 19 nt, artificial
  Chemically synthesized
cuaaacucuucaaaugcuu

SEQ ID NO: 2236 - RNA, 19 nt, artificial
  Chemically synthesized
cuuggauaccugucacuag

SEQ ID NO: 2237 - RNA, 19 nt, artificial
  Chemically synthesized
caacgagguaauauuugag

SEQ ID NO: 2238 - RNA, 19 nt, artificial
  Chemically synthesized
gagguuguguuaugcacgu

SEQ ID NO: 2239 - RNA, 19 nt, artificial
  Chemically synthesized
cuugccagaauuugguuaa

SEQ ID NO: 2240 - RNA, 19 nt, artificial
  Chemically synthesized
aaaagcuuguggugccauu

SEQ ID NO: 2241 - RNA, 19 nt, artificial
  Chemically synthesized
gcaaggcuuucauauccuu

SEQ ID NO: 2242 - RNA, 19 nt, artificial
  Chemically synthesized
accugucacuagggaauaa

SEQ ID NO: 2243 - RNA, 19 nt, artificial
  Chemically synthesized
agcuuguggugccauuuca

SEQ ID NO: 2244 - RNA, 19 nt, artificial
  Chemically synthesized
gggacuuuuucuuuaguag

SEQ ID NO: 2245 - RNA, 19 nt, artificial
  Chemically synthesized
cuagguaagaguaaaugag

SEQ ID NO: 2246 - RNA, 19 nt, artificial
  Chemically synthesized
cguaccuacuuuugagcuu

SEQ ID NO: 2247 - RNA, 19 nt, artificial
  Chemically synthesized
aagauacuacaaagccaau

SEQ ID NO: 2248 - RNA, 19 nt, artificial
  Chemically synthesized
cucaggauuucgacuuguu

SEQ ID NO: 2249 - RNA, 19 nt, artificial
  Chemically synthesized
cuuuauagaauugggccaa

SEQ ID NO: 2250 - RNA, 19 nt, artificial
  Chemically synthesized
cccauuuuuguacagaauu

SEQ ID NO: 2251 - RNA, 19 nt, artificial
  Chemically synthesized
uuguggugccauuucagua

SEQ ID NO: 2252 - RNA, 19 nt, artificial
  Chemically synthesized
guguguaguugauuacucu

SEQ ID NO: 2253 - RNA, 19 nt, artificial
  Chemically synthesized
guuuauaguacagccuaga

SEQ ID NO: 2254 - RNA, 19 nt, artificial
  Chemically synthesized
augagaaauauuacggcaa

SEQ ID NO: 2255 - RNA, 19 nt, artificial
  Chemically synthesized
cacccagauuuuuuccacc

SEQ ID NO: 2256 - RNA, 19 nt, artificial
  Chemically synthesized
aucccauuuuuguacagaa

SEQ ID NO: 2257 - RNA, 19 nt, artificial
  Chemically synthesized
cagaauugcuggacugugg

SEQ ID NO: 2258 - RNA, 19 nt, artificial
  Chemically synthesized
ugacuacugggauuauguu

SEQ ID NO: 2259 - RNA, 19 nt, artificial
  Chemically synthesized
gauccuguuacugauacua

SEQ ID NO: 2260 - RNA, 19 nt, artificial
  Chemically synthesized
uccaaaucaaagcaaacua

SEQ ID NO: 2261 - RNA, 19 nt, artificial
  Chemically synthesized
ucugggcuuuucugggaau

SEQ ID NO: 2262 - RNA, 19 nt, artificial
  Chemically synthesized
ccauuuuuguacagaauug

SEQ ID NO: 2263 - RNA, 19 nt, artificial
  Chemically synthesized
cuggccuuuggagaaguga

SEQ ID NO: 2264 - RNA, 19 nt, artificial
  Chemically synthesized
uaggaaauuaguucugaga

SEQ ID NO: 2265 - RNA, 19 nt, artificial
  Chemically synthesized
cuuaaucucagaugaacca

SEQ ID NO: 2266 - RNA, 19 nt, artificial
  Chemically synthesized
aggaaauuaguucugagau

SEQ ID NO: 2267 - RNA, 19 nt, artificial
  Chemically synthesized
aggcuugguaauagacuau

SEQ ID NO: 2268 - RNA, 19 nt, artificial
  Chemically synthesized
gaauuugguuaaaaugcug

SEQ ID NO: 2269 - RNA, 19 nt, artificial
  Chemically synthesized
uagacaggaagguaggauu

SEQ ID NO: 2270 - RNA, 19 nt, artificial
  Chemically synthesized
uugaaguaucucuccuuaa

SEQ ID NO: 2271 - RNA, 19 nt, artificial
  Chemically synthesized
cuuugacucucuugccugu

SEQ ID NO: 2272 - RNA, 19 nt, artificial
  Chemically synthesized
uguggcuaucacccagaga

SEQ ID NO: 2273 - RNA, 19 nt, artificial
  Chemically synthesized
aggccuuauuuuuugucuu

SEQ ID NO: 2274 - RNA, 19 nt, artificial
  Chemically synthesized
caguguuaucucaucucug

SEQ ID NO: 2275 - RNA, 19 nt, artificial
  Chemically synthesized
ugagaaacugacccagaga

SEQ ID NO: 2276 - RNA, 19 nt, artificial
  Chemically synthesized
uguuguuccugaacccaac

SEQ ID NO: 2277 - RNA, 19 nt, artificial
  Chemically synthesized
guuguccuuuuuccacuaa

SEQ ID NO: 2278 - RNA, 19 nt, artificial
  Chemically synthesized
ggcaauaauggaacugcuu

SEQ ID NO: 2279 - RNA, 19 nt, artificial
  Chemically synthesized
acaauguucaauucagcaa

SEQ ID NO: 2280 - RNA, 19 nt, artificial
  Chemically synthesized
gcaacuggcaguuugagca

SEQ ID NO: 2281 - RNA, 19 nt, artificial
  Chemically synthesized
ggguuuuuagacaggaagg

SEQ ID NO: 2282 - RNA, 19 nt, artificial
  Chemically synthesized
guaggauuaaguaggugag

SEQ ID NO: 2283 - RNA, 19 nt, artificial
  Chemically synthesized
ugaaacucaccguccagau

SEQ ID NO: 2284 - RNA, 19 nt, artificial
  Chemically synthesized
ugauccuguuacugauacu

SEQ ID NO: 2285 - RNA, 19 nt, artificial
  Chemically synthesized
auuucaugauuggguagua

SEQ ID NO: 2286 - RNA, 19 nt, artificial
  Chemically synthesized
agaugccuuuauaagcuca

SEQ ID NO: 2287 - RNA, 19 nt, artificial
  Chemically synthesized
ccucaacgagguaauauuu

SEQ ID NO: 2288 - RNA, 19 nt, artificial
  Chemically synthesized
guuaagcuccaaagguuca

SEQ ID NO: 2289 - RNA, 19 nt, artificial
  Chemically synthesized
ccuagcuauuagcuccacu

SEQ ID NO: 2290 - RNA, 19 nt, artificial
  Chemically synthesized
guagggacagauguauuca

SEQ ID NO: 2291 - RNA, 19 nt, artificial
  Chemically synthesized
uucuguguuucacauucau

SEQ ID NO: 2292 - RNA, 19 nt, artificial
  Chemically synthesized
gguaggcuugguaauagac

SEQ ID NO: 2293 - RNA, 19 nt, artificial
  Chemically synthesized
caggugugauccuguuacu

SEQ ID NO: 2294 - RNA, 19 nt, artificial
  Chemically synthesized
uauucagcuagucagcuaa

SEQ ID NO: 2295 - RNA, 19 nt, artificial
  Chemically synthesized
acucuucaaaugcuuggaa

SEQ ID NO: 2296 - RNA, 19 nt, artificial
  Chemically synthesized
uggacuagcuucagggacu

SEQ ID NO: 2297 - RNA, 19 nt, artificial
  Chemically synthesized
ugcacgugaacuuggaaau

SEQ ID NO: 2298 - RNA, 19 nt, artificial
  Chemically synthesized
caucgauguagaacuguug

SEQ ID NO: 2299 - RNA, 19 nt, artificial
  Chemically synthesized
gagcuuacacuuguguuua

SEQ ID NO: 2300 - RNA, 19 nt, artificial
  Chemically synthesized
uguuucacauucauagcaa

SEQ ID NO: 2301 - RNA, 19 nt, artificial
  Chemically synthesized
ccucacucuaauguuuuaa

SEQ ID NO: 2302 - RNA, 19 nt, artificial
  Chemically synthesized
ggcugauuuucuggccuuu

SEQ ID NO: 2303 - RNA, 19 nt, artificial
  Chemically synthesized
ucugggaauugaaguaucu

SEQ ID NO: 2304 - RNA, 19 nt, artificial
  Chemically synthesized
cuuuugagcuuacacuugu

SEQ ID NO: 2305 - RNA, 19 nt, artificial
  Chemically synthesized
cacuguuucuuggugacuu

SEQ ID NO: 2306 - RNA, 19 nt, artificial
  Chemically synthesized
uguucaaauuagccagugu

SEQ ID NO: 2307 - RNA, 19 nt, artificial
  Chemically synthesized
aaugagaaauauuacggca

SEQ ID NO: 2308 - RNA, 19 nt, artificial
  Chemically synthesized
cauggcaguguuaucucau

SEQ ID NO: 2309 - RNA, 19 nt, artificial
  Chemically synthesized
cuguuaugcuuacaaaaug

SEQ ID NO: 2310 - RNA, 19 nt, artificial
  Chemically synthesized
gcuuucauauccuugcugu

SEQ ID NO: 2311 - RNA, 19 nt, artificial
  Chemically synthesized
agcuaaagucauuuguagu

SEQ ID NO: 2312 - RNA, 19 nt, artificial
  Chemically synthesized
ucuguguuucacauucaua

SEQ ID NO: 2313 - RNA, 19 nt, artificial
  Chemically synthesized
auuagccaguguucuaaca

SEQ ID NO: 2314 - RNA, 19 nt, artificial
  Chemically synthesized
aguagaagcccauuugagu

SEQ ID NO: 2315 - RNA, 19 nt, artificial
  Chemically synthesized
auguauucauccugguguu

SEQ ID NO: 2316 - RNA, 19 nt, artificial
  Chemically synthesized
guaguugauuacucuucca

SEQ ID NO: 2317 - RNA, 19 nt, artificial
  Chemically synthesized
uguaaaaagcuggauagga

SEQ ID NO: 2318 - RNA, 19 nt, artificial
  Chemically synthesized
uguuuugcaugucuauugu

SEQ ID NO: 2319 - RNA, 19 nt, artificial
  Chemically synthesized
cuucaaaugcuuggaaaga

SEQ ID NO: 2320 - RNA, 19 nt, artificial
  Chemically synthesized
ucauagcaacugcagcuaa

SEQ ID NO: 2321 - RNA, 19 nt, artificial
  Chemically synthesized
cagccuagagaaugaaacu

SEQ ID NO: 2322 - RNA, 19 nt, artificial
  Chemically synthesized
uauuacggcaauaauggaa

SEQ ID NO: 2323 - RNA, 19 nt, artificial
  Chemically synthesized
aaagguucacuguguuucu

SEQ ID NO: 2324 - RNA, 19 nt, artificial
  Chemically synthesized
gugauuuugacuacuggga

SEQ ID NO: 2325 - RNA, 19 nt, artificial
  Chemically synthesized
aagcaaaaguagaagccca

SEQ ID NO: 2326 - RNA, 19 nt, artificial
  Chemically synthesized
gguuuccugcccuagcuau

SEQ ID NO: 2327 - RNA, 19 nt, artificial
  Chemically synthesized
cucuuuucuuucuguguuu

SEQ ID NO: 2328 - RNA, 19 nt, artificial
  Chemically synthesized
gcccuagcuauuagcucca

SEQ ID NO: 2329 - RNA, 19 nt, artificial
  Chemically synthesized
ccagcauuucagaauugcu

SEQ ID NO: 2330 - RNA, 19 nt, artificial
  Chemically synthesized
agggacuuuuucuuuagua

SEQ ID NO: 2331 - RNA, 19 nt, artificial
  Chemically synthesized
caaauguagucucuuuucu

SEQ ID NO: 2332 - RNA, 19 nt, artificial
  Chemically synthesized
ccaagauaaaucaauguug

SEQ ID NO: 2333 - RNA, 19 nt, artificial
  Chemically synthesized
auguauguaaaaagcugga

SEQ ID NO: 2334 - RNA, 19 nt, artificial
  Chemically synthesized
cgguguuguuuuagaugcc

SEQ ID NO: 2335 - RNA, 19 nt, artificial
  Chemically synthesized
cagauuuuuuccaccuugg

SEQ ID NO: 2336 - RNA, 19 nt, artificial
  Chemically synthesized
caaaaguagaagcccauuu

SEQ ID NO: 2337 - RNA, 19 nt, artificial
  Chemically synthesized
uuauagaauugggccaaga

SEQ ID NO: 2338 - RNA, 19 nt, artificial
  Chemically synthesized
aagguaggauuaaguaggu

SEQ ID NO: 2339 - RNA, 19 nt, artificial
  Chemically synthesized
uaaggagcuuauucagguu

SEQ ID NO: 2340 - RNA, 19 nt, artificial
  Chemically synthesized
guguuguuuuagaugccuu

SEQ ID NO: 2341 - RNA, 19 nt, artificial
  Chemically synthesized
guuuccugcccuagcuauu

SEQ ID NO: 2342 - RNA, 19 nt, artificial
  Chemically synthesized
auucagcaaggcuuucaua

SEQ ID NO: 2343 - RNA, 19 nt, artificial
  Chemically synthesized
caauuugguuucagguagg

SEQ ID NO: 2344 - RNA, 19 nt, artificial
  Chemically synthesized
guuguuuuagaugccuuua

SEQ ID NO: 2345 - RNA, 19 nt, artificial
  Chemically synthesized
gcauuggcuauggagauau

SEQ ID NO: 2346 - RNA, 19 nt, artificial
  Chemically synthesized
cugagaaacugacccagag

SEQ ID NO: 2347 - RNA, 19 nt, artificial
  Chemically synthesized
uaugcuuacaaaaugguga

SEQ ID NO: 2348 - RNA, 19 nt, artificial
  Chemically synthesized
aacuaaacuugguugcuca

SEQ ID NO: 2349 - RNA, 19 nt, artificial
  Chemically synthesized
aaugcuuggaaagauacua

SEQ ID NO: 2350 - RNA, 19 nt, artificial
  Chemically synthesized
gucuguccaaaucaaagca

SEQ ID NO: 2351 - RNA, 19 nt, artificial
  Chemically synthesized
auugcuggacuguggcuau

SEQ ID NO: 2352 - RNA, 19 nt, artificial
  Chemically synthesized
uuaguuuguuagaacacug

SEQ ID NO: 2353 - RNA, 19 nt, artificial
  Chemically synthesized
uaguuuguuagaacacugg

SEQ ID NO: 2354 - RNA, 19 nt, artificial
  Chemically synthesized
uucaauucccagaaaagcc

SEQ ID NO: 2355 - RNA, 19 nt, artificial
  Chemically synthesized
uucaauuuccaaguucacg

SEQ ID NO: 2356 - RNA, 19 nt, artificial
  Chemically synthesized
uugcuuaccuauuccaucc

SEQ ID NO: 2357 - RNA, 19 nt, artificial
  Chemically synthesized
uuuguuagaacacuggcua

SEQ ID NO: 2358 - RNA, 19 nt, artificial
  Chemically synthesized
uuuuuaggacccuucaauc

SEQ ID NO: 2359 - RNA, 19 nt, artificial
  Chemically synthesized
uuuaucuuggcccaauucu

SEQ ID NO: 2360 - RNA, 19 nt, artificial
  Chemically synthesized
uuauccacgacccacagca

SEQ ID NO: 2361 - RNA, 19 nt, artificial
  Chemically synthesized
uucucauuuacucuuaccu

SEQ ID NO: 2362 - RNA, 19 nt, artificial
  Chemically synthesized
uuugcuuugauuuggacag

SEQ ID NO: 2363 - RNA, 19 nt, artificial
  Chemically synthesized
uuuuacuacccaaucauga

SEQ ID NO: 2364 - RNA, 19 nt, artificial
  Chemically synthesized
aguuuguuagaacacuggc

SEQ ID NO: 2365 - RNA, 19 nt, artificial
  Chemically synthesized
uuuaggacccuucaaucac

SEQ ID NO: 2366 - RNA, 19 nt, artificial
  Chemically synthesized
auuaauuuaacagccuucc

SEQ ID NO: 2367 - RNA, 19 nt, artificial
  Chemically synthesized
uuaacagccuuccauaagc

SEQ ID NO: 2368 - RNA, 19 nt, artificial
  Chemically synthesized
uauaguaucaguaacagga

SEQ ID NO: 2369 - RNA, 19 nt, artificial
  Chemically synthesized
uuucucagggacaaggacc

SEQ ID NO: 2370 - RNA, 19 nt, artificial
  Chemically synthesized
uucuccagcauuuuaacca

SEQ ID NO: 2371 - RNA, 19 nt, artificial
  Chemically synthesized
uucaucauucacucaaugg

SEQ ID NO: 2372 - RNA, 19 nt, artificial
  Chemically synthesized
uuaacaagucgaaauccug

SEQ ID NO: 2373 - RNA, 19 nt, artificial
  Chemically synthesized
ucaauuuccaaguucacgu

SEQ ID NO: 2374 - RNA, 19 nt, artificial
  Chemically synthesized
aucaguaacaggaucacac

SEQ ID NO: 2375 - RNA, 19 nt, artificial
  Chemically synthesized
uuccucaaauauuaccucg

SEQ ID NO: 2376 - RNA, 19 nt, artificial
  Chemically synthesized
uuguaguaucuuuccaagc

SEQ ID NO: 2377 - RNA, 19 nt, artificial
  Chemically synthesized
uugaacagugacauuuuag

SEQ ID NO: 2378 - RNA, 19 nt, artificial
  Chemically synthesized
auuagagugaggaagucac

SEQ ID NO: 2379 - RNA, 19 nt, artificial
  Chemically synthesized
uuuuguaagcauaacaggc

SEQ ID NO: 2380 - RNA, 19 nt, artificial
  Chemically synthesized
ucuauuaccaagccuaccu

SEQ ID NO: 2381 - RNA, 19 nt, artificial
  Chemically synthesized
auccucacagguauucauc

SEQ ID NO: 2382 - RNA, 19 nt, artificial
  Chemically synthesized
uauuauucccuagugacag

SEQ ID NO: 2383 - RNA, 19 nt, artificial
  Chemically synthesized
uuuguugccucuuuaaaac

SEQ ID NO: 2384 - RNA, 19 nt, artificial
  Chemically synthesized
guuuaguuuguuagaacac

SEQ ID NO: 2385 - RNA, 19 nt, artificial
  Chemically synthesized
auauagucuauuaccaagc

SEQ ID NO: 2386 - RNA, 19 nt, artificial
  Chemically synthesized
uuucaguaacaccaggaug

SEQ ID NO: 2387 - RNA, 19 nt, artificial
  Chemically synthesized
uuuggaaguuuugauaggc

SEQ ID NO: 2388 - RNA, 19 nt, artificial
  Chemically synthesized
uuuuucaguaacaccagga

SEQ ID NO: 2389 - RNA, 19 nt, artificial
  Chemically synthesized
aucuaaaacaacaccgugg

SEQ ID NO: 2390 - RNA, 19 nt, artificial
  Chemically synthesized
uucuugcugcucaaacugc

SEQ ID NO: 2391 - RNA, 19 nt, artificial
  Chemically synthesized
uuuguaguaucuuuccaag

SEQ ID NO: 2392 - RNA, 19 nt, artificial
  Chemically synthesized
uacgacgcuagaaucacac

SEQ ID NO: 2393 - RNA, 19 nt, artificial
  Chemically synthesized
uucuacaucgaugcccaag

SEQ ID NO: 2394 - RNA, 19 nt, artificial
  Chemically synthesized
ucaauucccagaaaagccc

SEQ ID NO: 2395 - RNA, 19 nt, artificial
  Chemically synthesized
uugauuuggacagacaguu

SEQ ID NO: 2396 - RNA, 19 nt, artificial
  Chemically synthesized
guuuguuagaacacuggcu

SEQ ID NO: 2397 - RNA, 19 nt, artificial
  Chemically synthesized
ucccuuuuuaggacccuuc

SEQ ID NO: 2398 - RNA, 19 nt, artificial
  Chemically synthesized
uuaccuaggguuaagcuuu

SEQ ID NO: 2399 - RNA, 19 nt, artificial
  Chemically synthesized
ucugagauuaagcacaugu

SEQ ID NO: 2400 - RNA, 19 nt, artificial
  Chemically synthesized
uaaaacauuagagugagga

SEQ ID NO: 2401 - RNA, 19 nt, artificial
  Chemically synthesized
uggcuuuguaguaucuuuc

SEQ ID NO: 2402 - RNA, 19 nt, artificial
  Chemically synthesized
uuccugucuaaaaacccuu

SEQ ID NO: 2403 - RNA, 19 nt, artificial
  Chemically synthesized
uucaguaacaccaggauga

SEQ ID NO: 2404 - RNA, 19 nt, artificial
  Chemically synthesized
uuauaguaucaguaacagg

SEQ ID NO: 2405 - RNA, 19 nt, artificial
  Chemically synthesized
uacaaaaaugggaucuaug

SEQ ID NO: 2406 - RNA, 19 nt, artificial
  Chemically synthesized
uauuccaucccauucaauu

SEQ ID NO: 2407 - RNA, 19 nt, artificial
  Chemically synthesized
uaauuuccuauccucacag

SEQ ID NO: 2408 - RNA, 19 nt, artificial
  Chemically synthesized
ucauuuacucuuaccuagg

SEQ ID NO: 2409 - RNA, 19 nt, artificial
  Chemically synthesized
aauaagcuccuuauccacg

SEQ ID NO: 2410 - RNA, 19 nt, artificial
  Chemically synthesized
ucaaaauaggcaaaucugg

SEQ ID NO: 2411 - RNA, 19 nt, artificial
  Chemically synthesized
uuuugaaucacuucuccaa

SEQ ID NO: 2412 - RNA, 19 nt, artificial
  Chemically synthesized
ucuggcaaguugauuccuc

SEQ ID NO: 2413 - RNA, 19 nt, artificial
  Chemically synthesized
uauugccguaauauuucuc

SEQ ID NO: 2414 - RNA, 19 nt, artificial
  Chemically synthesized
uuccaucccauucaauucu

SEQ ID NO: 2415 - RNA, 19 nt, artificial
  Chemically synthesized
uuuugcuuaccuauuccau

SEQ ID NO: 2416 - RNA, 19 nt, artificial
  Chemically synthesized
auccuauccagcuuuuuac

SEQ ID NO: 2417 - RNA, 19 nt, artificial
  Chemically synthesized
uugagucaggaacuggugg

SEQ ID NO: 2418 - RNA, 19 nt, artificial
  Chemically synthesized
uagaacacuggcuaauuug

SEQ ID NO: 2419 - RNA, 19 nt, artificial
  Chemically synthesized
uguuguuccaaucagugag

SEQ ID NO: 2420 - RNA, 19 nt, artificial
  Chemically synthesized
uuggacagacaguucucca

SEQ ID NO: 2421 - RNA, 19 nt, artificial
  Chemically synthesized
uuaucuuggcccaauucua

SEQ ID NO: 2422 - RNA, 19 nt, artificial
  Chemically synthesized
uuuccaagcauuugaagag

SEQ ID NO: 2423 - RNA, 19 nt, artificial
  Chemically synthesized
uccuuauccacgacccaca

SEQ ID NO: 2424 - RNA, 19 nt, artificial
  Chemically synthesized
ugaacagugacauuuuagg

SEQ ID NO: 2425 - RNA, 19 nt, artificial
  Chemically synthesized
uuuuaggacccuucaauca

SEQ ID NO: 2426 - RNA, 19 nt, artificial
  Chemically synthesized
uucucugggucaguuucuc

SEQ ID NO: 2427 - RNA, 19 nt, artificial
  Chemically synthesized
uuugagucaggaacuggug

SEQ ID NO: 2428 - RNA, 19 nt, artificial
  Chemically synthesized
ucagggacaaggaccuuug

SEQ ID NO: 2429 - RNA, 19 nt, artificial
  Chemically synthesized
agguauucaucauucacuc

SEQ ID NO: 2430 - RNA, 19 nt, artificial
  Chemically synthesized
ugaagcaguuccauuauug

SEQ ID NO: 2431 - RNA, 19 nt, artificial
  Chemically synthesized
ucaaagauaacuguuagug

SEQ ID NO: 2432 - RNA, 19 nt, artificial
  Chemically synthesized
ucaaaaguagguacgacgc

SEQ ID NO: 2433 - RNA, 19 nt, artificial
  Chemically synthesized
aauucugaaaugcuggccg

SEQ ID NO: 2434 - RNA, 19 nt, artificial
  Chemically synthesized
uucaucugagauuaagcac

SEQ ID NO: 2435 - RNA, 19 nt, artificial
  Chemically synthesized
uucacgugcauaacacaac

SEQ ID NO: 2436 - RNA, 19 nt, artificial
  Chemically synthesized
ucauucucuaggcuguacu

SEQ ID NO: 2437 - RNA, 19 nt, artificial
  Chemically synthesized
uuugauuuggacagacagu

SEQ ID NO: 2438 - RNA, 19 nt, artificial
  Chemically synthesized
uuaaacacaaguguaagcu

SEQ ID NO: 2439 - RNA, 19 nt, artificial
  Chemically synthesized
auaguuuuacuacccaauc

SEQ ID NO: 2440 - RNA, 19 nt, artificial
  Chemically synthesized
uuucaauuuccaaguucac

SEQ ID NO: 2441 - RNA, 19 nt, artificial
  Chemically synthesized
auuuuaaccaaauucuggc

SEQ ID NO: 2442 - RNA, 19 nt, artificial
  Chemically synthesized
uugcugcucaaacugccag

SEQ ID NO: 2443 - RNA, 19 nt, artificial
  Chemically synthesized
auuccaucccauucaauuc

SEQ ID NO: 2444 - RNA, 19 nt, artificial
  Chemically synthesized
uuuauuauucccuagugac

SEQ ID NO: 2445 - RNA, 19 nt, artificial
  Chemically synthesized
ucagagagggacuagaucu

SEQ ID NO: 2446 - RNA, 19 nt, artificial
  Chemically synthesized
ucuacaucgaugcccaaga

SEQ ID NO: 2447 - RNA, 19 nt, artificial
  Chemically synthesized
aucuugagcaauucucugg

SEQ ID NO: 2448 - RNA, 19 nt, artificial
  Chemically synthesized
ucaacacuuaagaacaggg

SEQ ID NO: 2449 - RNA, 19 nt, artificial
  Chemically synthesized
uugagcaauucucuggguc

SEQ ID NO: 2450 - RNA, 19 nt, artificial
  Chemically synthesized
uuugaaucacuucuccaaa

SEQ ID NO: 2451 - RNA, 19 nt, artificial
  Chemically synthesized
acagguauucaucauucac

SEQ ID NO: 2452 - RNA, 19 nt, artificial
  Chemically synthesized
uaacaagucgaaauccuga

SEQ ID NO: 2453 - RNA, 19 nt, artificial
  Chemically synthesized
cagguauucaucauucacu

SEQ ID NO: 2454 - RNA, 19 nt, artificial
  Chemically synthesized
uuaauccuaccuuccuguc

SEQ ID NO: 2455 - RNA, 19 nt, artificial
  Chemically synthesized
uuuucccuuuuuaggaccc

SEQ ID NO: 2456 - RNA, 19 nt, artificial
  Chemically synthesized
cugaauaagcuccuuaucc

SEQ ID NO: 2457 - RNA, 19 nt, artificial
  Chemically synthesized
uuuaacagccuuccauaag

SEQ ID NO: 2458 - RNA, 19 nt, artificial
  Chemically synthesized
aacggcucuguuuccuucg

SEQ ID NO: 2459 - RNA, 19 nt, artificial
  Chemically synthesized
gaguuuaguuuguuagaac

SEQ ID NO: 2460 - RNA, 19 nt, artificial
  Chemically synthesized
uuaccuauuccaucccauu

SEQ ID NO: 2461 - RNA, 19 nt, artificial
  Chemically synthesized
uucaacacuuaagaacagg

SEQ ID NO: 2462 - RNA, 19 nt, artificial
  Chemically synthesized
uaagacaaaaaauaaggcc

SEQ ID NO: 2463 - RNA, 19 nt, artificial
  Chemically synthesized
uacuaagugaaucagagag

SEQ ID NO: 2464 - RNA, 19 nt, artificial
  Chemically synthesized
ucuugcugcucaaacugcc

SEQ ID NO: 2465 - RNA, 19 nt, artificial
  Chemically synthesized
cucaaaaguagguacgacg

SEQ ID NO: 2466 - RNA, 19 nt, artificial
  Chemically synthesized
uggacggugaguuucauuc

SEQ ID NO: 2467 - RNA, 19 nt, artificial
  Chemically synthesized
uuggagcuuaacaauagac

SEQ ID NO: 2468 - RNA, 19 nt, artificial
  Chemically synthesized
uauuaccucguugagguug

SEQ ID NO: 2469 - RNA, 19 nt, artificial
  Chemically synthesized
uagucuauuaccaagccua

SEQ ID NO: 2470 - RNA, 19 nt, artificial
  Chemically synthesized
uauccagcuuuuuacauac

SEQ ID NO: 2471 - RNA, 19 nt, artificial
  Chemically synthesized
ucaaacugccaguugcaac

SEQ ID NO: 2472 - RNA, 19 nt, artificial
  Chemically synthesized
gugaguuucauucucuagg

SEQ ID NO: 2473 - RNA, 19 nt, artificial
  Chemically synthesized
ucaaaaucacuuagcaggc

SEQ ID NO: 2474 - RNA, 19 nt, artificial
  Chemically synthesized
ugugaaguggagcuaauag

SEQ ID NO: 2475 - RNA, 19 nt, artificial
  Chemically synthesized
uuaggacccuucaaucacu

SEQ ID NO: 2476 - RNA, 19 nt, artificial
  Chemically synthesized
uaguauacagcuacuaccc

SEQ ID NO: 2477 - RNA, 19 nt, artificial
  Chemically synthesized
auagacaugcaaaacaaca

SEQ ID NO: 2478 - RNA, 19 nt, artificial
  Chemically synthesized
ucaaauuugagucaggaac

SEQ ID NO: 2479 - RNA, 19 nt, artificial
  Chemically synthesized
aacaacaccgugguuacug

SEQ ID NO: 2480 - RNA, 19 nt, artificial
  Chemically synthesized
uccaagguggaaaaaaucu

SEQ ID NO: 2481 - RNA, 19 nt, artificial
  Chemically synthesized
ucuugagcaauucucuggg

SEQ ID NO: 2482 - RNA, 19 nt, artificial
  Chemically synthesized
aucaaaauaggcaaaucug

SEQ ID NO: 2483 - RNA, 19 nt, artificial
  Chemically synthesized
uuaauuuaacagccuucca

SEQ ID NO: 2484 - RNA, 19 nt, artificial
  Chemically synthesized
uucucuaggcuguacuaua

SEQ ID NO: 2485 - RNA, 19 nt, artificial
  Chemically synthesized
ucacgugcauaacacaacc

SEQ ID NO: 2486 - RNA, 19 nt, artificial
  Chemically synthesized
uucccuagugacagguauc

SEQ ID NO: 2487 - RNA, 19 nt, artificial
  Chemically synthesized
uuuuggaaguuuugauagg

SEQ ID NO: 2488 - RNA, 19 nt, artificial
  Chemically synthesized
aauacaucugucccuacgc

SEQ ID NO: 2489 - RNA, 19 nt, artificial
  Chemically synthesized
uuaggucacuuauaguauc

SEQ ID NO: 2490 - RNA, 19 nt, artificial
  Chemically synthesized
auagccaaugcagacuucg

SEQ ID NO: 2491 - RNA, 19 nt, artificial
  Chemically synthesized
aucacacacaauccuaucc

SEQ ID NO: 2492 - RNA, 19 nt, artificial
  Chemically synthesized
aaucacuucuccaaaggcc

SEQ ID NO: 2493 - RNA, 19 nt, artificial
  Chemically synthesized
ucuacuuuugcuuaccuau

SEQ ID NO: 2494 - RNA, 19 nt, artificial
  Chemically synthesized
ucaccuacuuaauccuacc

SEQ ID NO: 2495 - RNA, 19 nt, artificial
  Chemically synthesized
uaaacucaccuacuuaauc

SEQ ID NO: 2496 - RNA, 19 nt, artificial
  Chemically synthesized
uacuuaauccuaccuuccu

SEQ ID NO: 2497 - RNA, 19 nt, artificial
  Chemically synthesized
ucaguaacaggaucacacc

SEQ ID NO: 2498 - RNA, 19 nt, artificial
  Chemically synthesized
ucccugaagcuaguccaug

SEQ ID NO: 2499 - RNA, 19 nt, artificial
  Chemically synthesized
uccugucuaaaaacccuuc

SEQ ID NO: 2500 - RNA, 19 nt, artificial
  Chemically synthesized
uugaaucacuucuccaaag

SEQ ID NO: 2501 - RNA, 19 nt, artificial
  Chemically synthesized
auuuugaaucacuucucca

SEQ ID NO: 2502 - RNA, 19 nt, artificial
  Chemically synthesized
uaggacccuucaaucacug

SEQ ID NO: 2503 - RNA, 19 nt, artificial
  Chemically synthesized
ucccauucaauucuguaca

SEQ ID NO: 2504 - RNA, 19 nt, artificial
  Chemically synthesized
ucaaauauuaccucguuga

SEQ ID NO: 2505 - RNA, 19 nt, artificial
  Chemically synthesized
uucccagaaaagcccagag

SEQ ID NO: 2506 - RNA, 19 nt, artificial
  Chemically synthesized
uaacacaaccucgcaagcc

SEQ ID NO: 2507 - RNA, 19 nt, artificial
  Chemically synthesized
agcaguuccauuauugccg

SEQ ID NO: 2508 - RNA, 19 nt, artificial
  Chemically synthesized
uuccaaucagugaguaaag

SEQ ID NO: 2509 - RNA, 19 nt, artificial
  Chemically synthesized
ucuacuaaagaaaaagucc

SEQ ID NO: 2510 - RNA, 19 nt, artificial
  Chemically synthesized
auuacuaagugaaucagag

SEQ ID NO: 2511 - RNA, 19 nt, artificial
  Chemically synthesized
aucccauucaauucuguac

SEQ ID NO: 2512 - RNA, 19 nt, artificial
  Chemically synthesized
uaaggccuuuauuauuccc

SEQ ID NO: 2513 - RNA, 19 nt, artificial
  Chemically synthesized
uuuccuauccucacaggua

SEQ ID NO: 2514 - RNA, 19 nt, artificial
  Chemically synthesized
ucccuagugacagguaucc

SEQ ID NO: 2515 - RNA, 19 nt, artificial
  Chemically synthesized
aaaaagucccugaagcuag

SEQ ID NO: 2516 - RNA, 19 nt, artificial
  Chemically synthesized
uuggcuuuguaguaucuuu

SEQ ID NO: 2517 - RNA, 19 nt, artificial
  Chemically synthesized
uuacugaaauggcaccaca

SEQ ID NO: 2518 - RNA, 19 nt, artificial
  Chemically synthesized
uaucuuggcccaauucuau

SEQ ID NO: 2519 - RNA, 19 nt, artificial
  Chemically synthesized
uaccaagccuaccugaaac

SEQ ID NO: 2520 - RNA, 19 nt, artificial
  Chemically synthesized
aagcuccuuauccacgacc

SEQ ID NO: 2521 - RNA, 19 nt, artificial
  Chemically synthesized
uccauaagccaucaccauu

SEQ ID NO: 2522 - RNA, 19 nt, artificial
  Chemically synthesized
cugaaauggcaccacaagc

SEQ ID NO: 2523 - RNA, 19 nt, artificial
  Chemically synthesized
ucaucugagauuaagcaca

SEQ ID NO: 2524 - RNA, 19 nt, artificial
  Chemically synthesized
uucuacuuuugcuuaccua

SEQ ID NO: 2525 - RNA, 19 nt, artificial
  Chemically synthesized
uccaaaggccagaaaauca

SEQ ID NO: 2526 - RNA, 19 nt, artificial
  Chemically synthesized
acaucgaugcccaagaagc

SEQ ID NO: 2527 - RNA, 19 nt, artificial
  Chemically synthesized
ugcaugguuaucuggacgg

SEQ ID NO: 2528 - RNA, 19 nt, artificial
  Chemically synthesized
ucugggugcaugcaugguu

SEQ ID NO: 2529 - RNA, 19 nt, artificial
  Chemically synthesized
acuuaauccuaccuuccug

SEQ ID NO: 2530 - RNA, 19 nt, artificial
  Chemically synthesized
auuuaucuuggcccaauuc

SEQ ID NO: 2531 - RNA, 19 nt, artificial
  Chemically synthesized
acuaauuuccuauccucac

SEQ ID NO: 2532 - RNA, 19 nt, artificial
  Chemically synthesized
auccaagguggaaaaaauc

SEQ ID NO: 2533 - RNA, 19 nt, artificial
  Chemically synthesized
aaaaaaucugggugcaugc

SEQ ID NO: 2534 - RNA, 19 nt, artificial
  Chemically synthesized
gucaaaaucacuuagcagg

SEQ ID NO: 2535 - RNA, 19 nt, artificial
  Chemically synthesized
ucaggaacaacauaauccc

SEQ ID NO: 2536 - RNA, 19 nt, artificial
  Chemically synthesized
uuuguaagcauaacaggca

SEQ ID NO: 2537 - RNA, 19 nt, artificial
  Chemically synthesized
ugacagguauccaaggugg

SEQ ID NO: 2538 - RNA, 19 nt, artificial
  Chemically synthesized
aucacuucuccaaaggcca

SEQ ID NO: 2539 - RNA, 19 nt, artificial
  Chemically synthesized
aaaaaugggaucuaugcag

SEQ ID NO: 2540 - RNA, 19 nt, artificial
  Chemically synthesized
auuaccucguugagguugg

SEQ ID NO: 2541 - RNA, 19 nt, artificial
  Chemically synthesized
auucucugggucaguuucu

SEQ ID NO: 2542 - RNA, 19 nt, artificial
  Chemically synthesized
uagagugaggaagucacca

SEQ ID NO: 2543 - RNA, 19 nt, artificial
  Chemically synthesized
aaggccuuuauuauucccu

SEQ ID NO: 2544 - RNA, 19 nt, artificial
  Chemically synthesized
auuuuguaagcauaacagg

SEQ ID NO: 2545 - RNA, 19 nt, artificial
  Chemically synthesized
ucaaaugggcuucuacuuu

SEQ ID NO: 2546 - RNA, 19 nt, artificial
  Chemically synthesized
aaucccaguagucaaaauc

SEQ ID NO: 2547 - RNA, 19 nt, artificial
  Chemically synthesized
uaacagccuuccauaagcc

SEQ ID NO: 2548 - RNA, 19 nt, artificial
  Chemically synthesized
uaguggaaaaaggacaaca

SEQ ID NO: 2549 - RNA, 19 nt, artificial
  Chemically synthesized
auacaucugucccuacgcc

SEQ ID NO: 2550 - RNA, 19 nt, artificial
  Chemically synthesized
uaugcagaaaaucuacacu

SEQ ID NO: 2551 - RNA, 19 nt, artificial
  Chemically synthesized
uagugacagguauccaagg

SEQ ID NO: 2552 - RNA, 19 nt, artificial
  Chemically synthesized
caagguggaaaaaaucugg

SEQ ID NO: 2553 - RNA, 19 nt, artificial
  Chemically synthesized
ucucauuuacucuuaccua

SEQ ID NO: 2554 - RNA, 19 nt, artificial
  Chemically synthesized
uuucuuauuuagggcaggu

SEQ ID NO: 2555 - RNA, 19 nt, artificial
  Chemically synthesized
aacuaauuuccuauccuca

SEQ ID NO: 2556 - RNA, 19 nt, artificial
  Chemically synthesized
acuuagagaaaaaaaagcc

SEQ ID NO: 2557 - RNA, 19 nt, artificial
  Chemically synthesized
uucccuuuuuaggacccuu

SEQ ID NO: 2558 - RNA, 19 nt, artificial
  Chemically synthesized
uuccaaguucacgugcaua

SEQ ID NO: 2559 - RNA, 19 nt, artificial
  Chemically synthesized
uauagucuauuaccaagcc

SEQ ID NO: 2560 - RNA, 19 nt, artificial
  Chemically synthesized
guugcaaccauggucaacg

SEQ ID NO: 2561 - RNA, 19 nt, artificial
  Chemically synthesized
uggagcuuaacaauagaca

SEQ ID NO: 2562 - RNA, 19 nt, artificial
  Chemically synthesized
acaaaaaugggaucuaugc

SEQ ID NO: 2563 - RNA, 19 nt, artificial
  Chemically synthesized
augcagacuucguaaauug

SEQ ID NO: 2564 - RNA, 19 nt, artificial
  Chemically synthesized
acuuuugcuuaccuauucc

SEQ ID NO: 2565 - RNA, 19 nt, artificial
  Chemically synthesized
uacaaaugacuuuagcuga

SEQ ID NO: 2566 - RNA, 19 nt, artificial
  Chemically synthesized
acacacaauccuauccagc

SEQ ID NO: 2567 - RNA, 19 nt, artificial
  Chemically synthesized
cuacuuaauccuaccuucc

SEQ ID NO: 2568 - RNA, 19 nt, artificial
  Chemically synthesized
uucauucucuaggcuguac

SEQ ID NO: 2569 - RNA, 19 nt, artificial
  Chemically synthesized
uagguacgacgcuagaauc

SEQ ID NO: 2570 - RNA, 19 nt, artificial
  Chemically synthesized
aucagagagggacuagauc

SEQ ID NO: 2571 - RNA, 19 nt, artificial
  Chemically synthesized
aacccuucaaauuugaguc

SEQ ID NO: 2572 - RNA, 19 nt, artificial
  Chemically synthesized
uugaacauuguugagugga

SEQ ID NO: 2573 - RNA, 19 nt, artificial
  Chemically synthesized
ucuaugcagaaaaucuaca

SEQ ID NO: 2574 - RNA, 19 nt, artificial
  Chemically synthesized
auaagcuccuuauccacga

SEQ ID NO: 2575 - RNA, 19 nt, artificial
  Chemically synthesized
acuauaaaccauaucucca

SEQ ID NO: 2576 - RNA, 19 nt, artificial
  Chemically synthesized
auucaaagugguaguauac

SEQ ID NO: 2577 - RNA, 19 nt, artificial
  Chemically synthesized
uugcaaccauggucaacgg

SEQ ID NO: 2578 - RNA, 19 nt, artificial
  Chemically synthesized
ugcuuaccuauuccauccc

SEQ ID NO: 2579 - RNA, 19 nt, artificial
  Chemically synthesized
ugacccguuucaauaauuc

SEQ ID NO: 2580 - RNA, 19 nt, artificial
  Chemically synthesized
auaaaccauaucuccauag

SEQ ID NO: 2581 - RNA, 19 nt, artificial
  Chemically synthesized
ugaaucacuucuccaaagg

SEQ ID NO: 2582 - RNA, 19 nt, artificial
  Chemically synthesized
uguaaaacucaaaugggcu

SEQ ID NO: 2583 - RNA, 19 nt, artificial
  Chemically synthesized
uagaaucacacacaauccu

SEQ ID NO: 2584 - RNA, 19 nt, artificial
  Chemically synthesized
uguaguaucuuuccaagca

SEQ ID NO: 2585 - RNA, 19 nt, artificial
  Chemically synthesized
auuugagucaggaacuggu

SEQ ID NO: 2586 - RNA, 19 nt, artificial
  Chemically synthesized
aaaccauaucuccauagcc

SEQ ID NO: 2587 - RNA, 19 nt, artificial
  Chemically synthesized
uaacuguuaguggaaaaag

SEQ ID NO: 2588 - RNA, 19 nt, artificial
  Chemically synthesized
aagguggaaaaaaucuggg

SEQ ID NO: 2589 - RNA, 19 nt, artificial
  Chemically synthesized
auuuucccuuuuuaggacc

SEQ ID NO: 2590 - RNA, 19 nt, artificial
  Chemically synthesized
aagaaaaagucccugaagc

SEQ ID NO: 2591 - RNA, 19 nt, artificial
  Chemically synthesized
uuguugccucuuuaaaaca

SEQ ID NO: 2592 - RNA, 19 nt, artificial
  Chemically synthesized
auaaggccuuuauuauucc

SEQ ID NO: 2593 - RNA, 19 nt, artificial
  Chemically synthesized
agcuuaacaauagacaugc

SEQ ID NO: 2594 - RNA, 19 nt, artificial
  Chemically synthesized
uucucagggacaaggaccu

SEQ ID NO: 2595 - RNA, 19 nt, artificial
  Chemically synthesized
uccucacagguauucauca

SEQ ID NO: 2596 - RNA, 19 nt, artificial
  Chemically synthesized
ucaaagugguaguauacag

SEQ ID NO: 2597 - RNA, 19 nt, artificial
  Chemically synthesized
aucuaugcagaaaaucuac

SEQ ID NO: 2598 - RNA, 19 nt, artificial
  Chemically synthesized
uccaaguucacgugcauaa

SEQ ID NO: 2599 - RNA, 19 nt, artificial
  Chemically synthesized
aauucucugggucaguuuc

SEQ ID NO: 2600 - RNA, 19 nt, artificial
  Chemically synthesized
aauuugagucaggaacugg

SEQ ID NO: 2601 - RNA, 19 nt, artificial
  Chemically synthesized
uggucaacggcucuguuuc

SEQ ID NO: 2602 - RNA, 19 nt, artificial
  Chemically synthesized
auuuggacagacaguucuc

SEQ ID NO: 2603 - RNA, 19 nt, artificial
  Chemically synthesized
uuauuauucccuagugaca

SEQ ID NO: 2604 - RNA, 19 nt, artificial
  Chemically synthesized
auucaucauucacucaaug

SEQ ID NO: 2605 - RNA, 19 nt, artificial
  Chemically synthesized
uuucauucucuaggcugua

SEQ ID NO: 2606 - RNA, 19 nt, artificial
  Chemically synthesized
cugaggaucagaguucucc

SEQ ID NO: 2607 - RNA, 19 nt, artificial
  Chemically synthesized
uccucaaauauuaccucgu

SEQ ID NO: 2608 - RNA, 19 nt, artificial
  Chemically synthesized
acuaaagaaaaagucccug

SEQ ID NO: 2609 - RNA, 19 nt, artificial
  Chemically synthesized
aauggaagaguaaucaacu

SEQ ID NO: 2610 - RNA, 19 nt, artificial
  Chemically synthesized
cuucaaucacuguuguucc

SEQ ID NO: 2611 - RNA, 19 nt, artificial
  Chemically synthesized
ucaacggcucuguuuccuu

SEQ ID NO: 2612 - RNA, 19 nt, artificial
  Chemically synthesized
ucuauaaagauuggcuuug

SEQ ID NO: 2613 - RNA, 19 nt, artificial
  Chemically synthesized
uucguaaauugacccguuu

SEQ ID NO: 2614 - RNA, 19 nt, artificial
  Chemically synthesized
ucgaugcccaagaagccuu

SEQ ID NO: 2615 - RNA, 19 nt, artificial
  Chemically synthesized
ucugggucaguuucucagg

SEQ ID NO: 2616 - RNA, 19 nt, artificial
  Chemically synthesized
aucuccauagccaaugcag

SEQ ID NO: 2617 - RNA, 19 nt, artificial
  Chemically synthesized
gcuagaaucacacacaauc

SEQ ID NO: 2618 - RNA, 19 nt, artificial
  Chemically synthesized
augacuuuagcugacuagc

SEQ ID NO: 2619 - RNA, 19 nt, artificial
  Chemically synthesized
aguaacaccaggaugaaua

SEQ ID NO: 2620 - RNA, 19 nt, artificial
  Chemically synthesized
cugaauaguuuuacuaccc

SEQ ID NO: 2621 - RNA, 19 nt, artificial
  Chemically synthesized
ucuaaaacaacaccguggu

SEQ ID NO: 2622 - RNA, 19 nt, artificial
  Chemically synthesized
agagagucaaagauaacug

SEQ ID NO: 2623 - RNA, 19 nt, artificial
  Chemically synthesized
uaccugaaaccaaauugug

SEQ ID NO: 2624 - RNA, 19 nt, artificial
  Chemically synthesized
uaguuuuacuacccaauca

SEQ ID NO: 2625 - RNA, 19 nt, artificial
  Chemically synthesized
uacaucgaugcccaagaag

SEQ ID NO: 2626 - RNA, 19 nt, artificial
  Chemically synthesized
cuucaauucccagaaaagc

SEQ ID NO: 2627 - RNA, 19 nt, artificial
  Chemically synthesized
cuagaaucacacacaaucc

SEQ ID NO: 2628 - RNA, 19 nt, artificial
  Chemically synthesized
uccauagccaaugcagacu

SEQ ID NO: 2629 - RNA, 19 nt, artificial
  Chemically synthesized
uaaagauuggcuuuguagu

SEQ ID NO: 2630 - RNA, 19 nt, artificial
  Chemically synthesized
augcagaaaaucuacacua

SEQ ID NO: 2631 - RNA, 19 nt, artificial
  Chemically synthesized
aaugggcuucuacuuuugc

SEQ ID NO: 2632 - RNA, 19 nt, artificial
  Chemically synthesized
agacuucguaaauugaccc

SEQ ID NO: 2633 - RNA, 19 nt, artificial
  Chemically synthesized
aucgaugcccaagaagccu

SEQ ID NO: 2634 - RNA, 19 nt, artificial
  Chemically synthesized
aucacuguuguuccaauca

SEQ ID NO: 2635 - RNA, 19 nt, artificial
  Chemically synthesized
augaaagccuugcugaauu

SEQ ID NO: 2636 - RNA, 19 nt, artificial
  Chemically synthesized
cucacagguauucaucauu

SEQ ID NO: 2637 - RNA, 19 nt, artificial
  Chemically synthesized
uuccuauccucacagguau

SEQ ID NO: 2638 - RNA, 19 nt, artificial
  Chemically synthesized
uuuacuacccaaucaugaa

SEQ ID NO: 2639 - RNA, 19 nt, artificial
  Chemically synthesized
auaaagauuggcuuuguag

SEQ ID NO: 2640 - RNA, 19 nt, artificial
  Chemically synthesized
aaaaucacuuagcaggcuc

SEQ ID NO: 2641 - RNA, 19 nt, artificial
  Chemically synthesized
uuuacucuuaccuaggguu

SEQ ID NO: 2642 - RNA, 19 nt, artificial
  Chemically synthesized
uuacucuuaccuaggguua

SEQ ID NO: 2643 - RNA, 19 nt, artificial
  Chemically synthesized
auaagccaucaccauuuug

SEQ ID NO: 2644 - RNA, 19 nt, artificial
  Chemically synthesized
uuguuagaacacuggcuaa

SEQ ID NO: 2645 - RNA, 19 nt, artificial
  Chemically synthesized
uggaaaaaggacaacaguu

SEQ ID NO: 2646 - RNA, 19 nt, artificial
  Chemically synthesized
uccagcaauucugaaaugc

SEQ ID NO: 2647 - RNA, 19 nt, artificial
  Chemically synthesized
uaagcucaaaaguagguac

SEQ ID NO: 2648 - RNA, 19 nt, artificial
  Chemically synthesized
cuuugauuuggacagacag

SEQ ID NO: 2649 - RNA, 19 nt, artificial
  Chemically synthesized
uacuuaguuggaauaagac

SEQ ID NO: 2650 - RNA, 19 nt, artificial
  Chemically synthesized
uucuccugcuuaaacacaa

SEQ ID NO: 2651 - RNA, 19 nt, artificial
  Chemically synthesized
uuuuaaccaaauucuggca

SEQ ID NO: 2652 - RNA, 19 nt, artificial
  Chemically synthesized
ugccucuuuaaaacauuag

SEQ ID NO: 2653 - RNA, 19 nt, artificial
  Chemically synthesized
aaauccucugaaaacuuag

SEQ ID NO: 2654 - RNA, 19 nt, artificial
  Chemically synthesized
cuaggcuguacuauaaacc

SEQ ID NO: 2655 - RNA, 19 nt, artificial
  Chemically synthesized
cuuaauccuaccuuccugu

SEQ ID NO: 2656 - RNA, 19 nt, artificial
  Chemically synthesized
uucuccugaaaccagagga

SEQ ID NO: 2657 - RNA, 19 nt, artificial
  Chemically synthesized
aaaggcaucuaaaacaaca

SEQ ID NO: 2658 - RNA, 19 nt, artificial
  Chemically synthesized
uuacuaagugaaucagaga

SEQ ID NO: 2659 - RNA, 19 nt, artificial
  Chemically synthesized
aucccaguagucaaaauca

SEQ ID NO: 2660 - RNA, 19 nt, artificial
  Chemically synthesized
aucacuuagcaggcucucu

SEQ ID NO: 2661 - RNA, 19 nt, artificial
  Chemically synthesized
ccuuccauaagccaucacc

SEQ ID NO: 2662 - RNA, 19 nt, artificial
  Chemically synthesized
acagcuacuacccuugaca

SEQ ID NO: 2663 - RNA, 19 nt, artificial
  Chemically synthesized
ugaaaccagaggagaagcg

SEQ ID NO: 2664 - RNA, 19 nt, artificial
  Chemically synthesized
uagacaugcaaaacaacau

SEQ ID NO: 2665 - RNA, 19 nt, artificial
  Chemically synthesized
aaaguagguacgacgcuag

SEQ ID NO: 2666 - RNA, 19 nt, artificial
  Chemically synthesized
ugcaugcaugguuaucugg

SEQ ID NO: 2667 - RNA, 19 nt, artificial
  Chemically synthesized
uggugugggcuuuuggaag

SEQ ID NO: 2668 - RNA, 19 nt, artificial
  Chemically synthesized
aagagagucaaagauaacu

SEQ ID NO: 2669 - RNA, 19 nt, artificial
  Chemically synthesized
acaguauucaacacuuaag

SEQ ID NO: 2670 - RNA, 19 nt, artificial
  Chemically synthesized
guuagcugcaguugcuaug

SEQ ID NO: 2671 - RNA, 19 nt, artificial
  Chemically synthesized
auucugaaaugcuggccgg

SEQ ID NO: 2672 - RNA, 19 nt, artificial
  Chemically synthesized
acauugauuuaucuuggcc

SEQ ID NO: 2673 - RNA, 19 nt, artificial
  Chemically synthesized
uccauuauugccguaauau

SEQ ID NO: 2674 - RNA, 19 nt, artificial
  Chemically synthesized
aacauuagagugaggaagu

SEQ ID NO: 2675 - RNA, 19 nt, artificial
  Chemically synthesized
aauccuauccagcuuuuua

SEQ ID NO: 2676 - RNA, 19 nt, artificial
  Chemically synthesized
uuggguucaggaacaacau

SEQ ID NO: 2677 - RNA, 19 nt, artificial
  Chemically synthesized
ucagaguucuccugaaacc

SEQ ID NO: 2678 - RNA, 19 nt, artificial
  Chemically synthesized
acugccaguugcaaccaug

SEQ ID NO: 2679 - RNA, 19 nt, artificial
  Chemically synthesized
uuaccaagccuaccugaaa

SEQ ID NO: 2680 - RNA, 19 nt, artificial
  Chemically synthesized
uaucaguaacaggaucaca

SEQ ID NO: 2681 - RNA, 19 nt, artificial
  Chemically synthesized
uuacuacccaaucaugaaa

SEQ ID NO: 2682 - RNA, 19 nt, artificial
  Chemically synthesized
uaccuuccugucuaaaaac

SEQ ID NO: 2683 - RNA, 19 nt, artificial
  Chemically synthesized
uagcuagggcaggaaaccu

SEQ ID NO: 2684 - RNA, 19 nt, artificial
  Chemically synthesized
gcugaauugaacauuguug

SEQ ID NO: 2685 - RNA, 19 nt, artificial
  Chemically synthesized
auguaauacugaaaagagg

SEQ ID NO: 2686 - RNA, 19 nt, artificial
  Chemically synthesized
uacagcuacuacccuugac

SEQ ID NO: 2687 - RNA, 19 nt, artificial
  Chemically synthesized
aaagacaguauucaacacu

SEQ ID NO: 2688 - RNA, 19 nt, artificial
  Chemically synthesized
ccuucaaucacuguuguuc

SEQ ID NO: 2689 - RNA, 19 nt, artificial
  Chemically synthesized
uguaauacugaaaagagga

SEQ ID NO: 2690 - RNA, 19 nt, artificial
  Chemically synthesized
uucuggcaaguugauuccu

SEQ ID NO: 2691 - RNA, 19 nt, artificial
  Chemically synthesized
augcaugguuaucuggacg

SEQ ID NO: 2692 - RNA, 19 nt, artificial
  Chemically synthesized
aacuguuaguggaaaaagg

SEQ ID NO: 2693 - RNA, 19 nt, artificial
  Chemically synthesized
uccaucccauucaauucug

SEQ ID NO: 2694 - RNA, 19 nt, artificial
  Chemically synthesized
uucuccaaaggccagaaaa

SEQ ID NO: 2695 - RNA, 19 nt, artificial
  Chemically synthesized
acuaagugaaucagagagg

SEQ ID NO: 2696 - RNA, 19 nt, artificial
  Chemically synthesized
aagugaaucagagagggac

SEQ ID NO: 2697 - RNA, 19 nt, artificial
  Chemically synthesized
uuucccuuuuuaggacccu

SEQ ID NO: 2698 - RNA, 19 nt, artificial
  Chemically synthesized
aucuuggcccaauucuaua

SEQ ID NO: 2699 - RNA, 19 nt, artificial
  Chemically synthesized
aucagaguucuccugaaac

SEQ ID NO: 2700 - RNA, 19 nt, artificial
  Chemically synthesized
gugaaguggagcuaauagc

SEQ ID NO: 2701 - RNA, 19 nt, artificial
  Chemically synthesized
auugauuuaucuuggccca

SEQ ID NO: 2702 - RNA, 19 nt, artificial
  Chemically synthesized
aaacccuucaaauuugagu

SEQ ID NO: 2703 - RNA, 19 nt, artificial
  Chemically synthesized
cagaaaaucagccuguuag

SEQ ID NO: 2704 - RNA, 19 nt, artificial
  Chemically synthesized
cuugcugaauugaacauug

SEQ ID NO: 2705 - RNA, 19 nt, artificial
  Chemically synthesized
cuguuuuucaguaacacca

SEQ ID NO: 2706 - RNA, 19 nt, artificial
  Chemically synthesized
ugagguuggguucaggaac

SEQ ID NO: 2707 - RNA, 19 nt, artificial
  Chemically synthesized
ugaggaucagaguucuccu

SEQ ID NO: 2708 - RNA, 19 nt, artificial
  Chemically synthesized
uuuaaccaaauucuggcaa

SEQ ID NO: 2709 - RNA, 19 nt, artificial
  Chemically synthesized
uucaaagugguaguauaca

SEQ ID NO: 2710 - RNA, 19 nt, artificial
  Chemically synthesized
uuuucaguaacaccaggau

SEQ ID NO: 2711 - RNA, 19 nt, artificial
  Chemically synthesized
aaaaucagccuguuagcug

SEQ ID NO: 2712 - RNA, 19 nt, artificial
  Chemically synthesized
aaaagagacuacauuuggg

SEQ ID NO: 2713 - RNA, 19 nt, artificial
  Chemically synthesized
aaucugggugcaugcaugg

SEQ ID NO: 2714 - RNA, 19 nt, artificial
  Chemically synthesized
uuccauaagccaucaccau

SEQ ID NO: 2715 - RNA, 19 nt, artificial
  Chemically synthesized
ugccauggugaaaugguuc

SEQ ID NO: 2716 - RNA, 19 nt, artificial
  Chemically synthesized
uugagcaaccaaguuuagu

SEQ ID NO: 2717 - RNA, 19 nt, artificial
  Chemically synthesized
augggaucuaugcagaaaa

SEQ ID NO: 2718 - RNA, 19 nt, artificial
  Chemically synthesized
uagccaaugcagacuucgu

SEQ ID NO: 2719 - RNA, 19 nt, artificial
  Chemically synthesized
aaggaaagagauaaugauc

SEQ ID NO: 2720 - RNA, 19 nt, artificial
  Chemically synthesized
aaccauaucuccauagcca

SEQ ID NO: 2721 - RNA, 19 nt, artificial
  Chemically synthesized
guaguauacagcuacuacc

SEQ ID NO: 2722 - RNA, 19 nt, artificial
  Chemically synthesized
uugauuuaucuuggcccaa

SEQ ID NO: 2723 - RNA, 19 nt, artificial
  Chemically synthesized
uacuacccuugacaauugg

SEQ ID NO: 2724 - RNA, 19 nt, artificial
  Chemically synthesized
aagaggauagauuacuaag

SEQ ID NO: 2725 - RNA, 19 nt, artificial
  Chemically synthesized
cuuccauaagccaucacca

SEQ ID NO: 2726 - RNA, 19 nt, artificial
  Chemically synthesized
ucaguggugacaacuccag

SEQ ID NO: 2727 - RNA, 19 nt, artificial
  Chemically synthesized
acuguuguuccaaucagug

SEQ ID NO: 2728 - RNA, 19 nt, artificial
  Chemically synthesized
guucuugcugcucaaacug

SEQ ID NO: 2729 - RNA, 19 nt, artificial
  Chemically synthesized
augaauacaucugucccua

SEQ ID NO: 2730 - RNA, 19 nt, artificial
  Chemically synthesized
cccaauucuauaaagauug

SEQ ID NO: 2731 - RNA, 19 nt, artificial
  Chemically synthesized
uguuaguggaaaaaggaca

SEQ ID NO: 2732 - RNA, 19 nt, artificial
  Chemically synthesized
uauuuucccuuuuuaggac

SEQ ID NO: 2733 - RNA, 19 nt, artificial
  Chemically synthesized
caaacugccaguugcaacc

SEQ ID NO: 2734 - RNA, 19 nt, artificial
  Chemically synthesized
uuggaaguuuugauaggcu

SEQ ID NO: 2735 - RNA, 19 nt, artificial
  Chemically synthesized
aagcauuugaagaguuuag

SEQ ID NO: 2736 - RNA, 19 nt, artificial
  Chemically synthesized
cuagugacagguauccaag

SEQ ID NO: 2737 - RNA, 19 nt, artificial
  Chemically synthesized
cucaaauauuaccucguug

SEQ ID NO: 2738 - RNA, 19 nt, artificial
  Chemically synthesized
acgugcauaacacaaccuc

SEQ ID NO: 2739 - RNA, 19 nt, artificial
  Chemically synthesized
uuaaccaaauucuggcaag

SEQ ID NO: 2740 - RNA, 19 nt, artificial
  Chemically synthesized
aauggcaccacaagcuuuu

SEQ ID NO: 2741 - RNA, 19 nt, artificial
  Chemically synthesized
aaggauaugaaagccuugc

SEQ ID NO: 2742 - RNA, 19 nt, artificial
  Chemically synthesized
uuauucccuagugacaggu

SEQ ID NO: 2743 - RNA, 19 nt, artificial
  Chemically synthesized
ugaaauggcaccacaagcu

SEQ ID NO: 2744 - RNA, 19 nt, artificial
  Chemically synthesized
cuacuaaagaaaaaguccc

SEQ ID NO: 2745 - RNA, 19 nt, artificial
  Chemically synthesized
cucauuuacucuuaccuag

SEQ ID NO: 2746 - RNA, 19 nt, artificial
  Chemically synthesized
aagcucaaaaguagguacg

SEQ ID NO: 2747 - RNA, 19 nt, artificial
  Chemically synthesized
auuggcuuuguaguaucuu

SEQ ID NO: 2748 - RNA, 19 nt, artificial
  Chemically synthesized
aacaagucgaaauccugag

SEQ ID NO: 2749 - RNA, 19 nt, artificial
  Chemically synthesized
uuggcccaauucuauaaag

SEQ ID NO: 2750 - RNA, 19 nt, artificial
  Chemically synthesized
aauucuguacaaaaauggg

SEQ ID NO: 2751 - RNA, 19 nt, artificial
  Chemically synthesized
uacugaaauggcaccacaa

SEQ ID NO: 2752 - RNA, 19 nt, artificial
  Chemically synthesized
agaguaaucaacuacacac

SEQ ID NO: 2753 - RNA, 19 nt, artificial
  Chemically synthesized
ucuaggcuguacuauaaac

SEQ ID NO: 2754 - RNA, 19 nt, artificial
  Chemically synthesized
uugccguaauauuucucau

SEQ ID NO: 2755 - RNA, 19 nt, artificial
  Chemically synthesized
gguggaaaaaaucugggug

SEQ ID NO: 2756 - RNA, 19 nt, artificial
  Chemically synthesized
uucuguacaaaaaugggau

SEQ ID NO: 2757 - RNA, 19 nt, artificial
  Chemically synthesized
ccacaguccagcaauucug

SEQ ID NO: 2758 - RNA, 19 nt, artificial
  Chemically synthesized
aacauaaucccaguaguca

SEQ ID NO: 2759 - RNA, 19 nt, artificial
  Chemically synthesized
uaguaucaguaacaggauc

SEQ ID NO: 2760 - RNA, 19 nt, artificial
  Chemically synthesized
uaguuugcuuugauuugga

SEQ ID NO: 2761 - RNA, 19 nt, artificial
  Chemically synthesized
auucccagaaaagcccaga

SEQ ID NO: 2762 - RNA, 19 nt, artificial
  Chemically synthesized
caauucuguacaaaaaugg

SEQ ID NO: 2763 - RNA, 19 nt, artificial
  Chemically synthesized
ucacuucuccaaaggccag

SEQ ID NO: 2764 - RNA, 19 nt, artificial
  Chemically synthesized
ucucagaacuaauuuccua

SEQ ID NO: 2765 - RNA, 19 nt, artificial
  Chemically synthesized
ugguucaucugagauuaag

SEQ ID NO: 2766 - RNA, 19 nt, artificial
  Chemically synthesized
aucucagaacuaauuuccu

SEQ ID NO: 2767 - RNA, 19 nt, artificial
  Chemically synthesized
auagucuauuaccaagccu

SEQ ID NO: 2768 - RNA, 19 nt, artificial
  Chemically synthesized
cagcauuuuaaccaaauuc

SEQ ID NO: 2769 - RNA, 19 nt, artificial
  Chemically synthesized
aauccuaccuuccugucua

SEQ ID NO: 2770 - RNA, 19 nt, artificial
  Chemically synthesized
uuaaggagagauacuucaa

SEQ ID NO: 2771 - RNA, 19 nt, artificial
  Chemically synthesized
acaggcaagagagucaaag

SEQ ID NO: 2772 - RNA, 19 nt, artificial
  Chemically synthesized
ucucugggugauagccaca

SEQ ID NO: 2773 - RNA, 19 nt, artificial
  Chemically synthesized
aagacaaaaaauaaggccu

SEQ ID NO: 2774 - RNA, 19 nt, artificial
  Chemically synthesized
cagagaugagauaacacug

SEQ ID NO: 2775 - RNA, 19 nt, artificial
  Chemically synthesized
ucucugggucaguuucuca

SEQ ID NO: 2776 - RNA, 19 nt, artificial
  Chemically synthesized
guuggguucaggaacaaca

SEQ ID NO: 2777 - RNA, 19 nt, artificial
  Chemically synthesized
uuaguggaaaaaggacaac

SEQ ID NO: 2778 - RNA, 19 nt, artificial
  Chemically synthesized
aagcaguuccauuauugcc

SEQ ID NO: 2779 - RNA, 19 nt, artificial
  Chemically synthesized
uugcugaauugaacauugu

SEQ ID NO: 2780 - RNA, 19 nt, artificial
  Chemically synthesized
ugcucaaacugccaguugc

SEQ ID NO: 2781 - RNA, 19 nt, artificial
  Chemically synthesized
ccuuccugucuaaaaaccc

SEQ ID NO: 2782 - RNA, 19 nt, artificial
  Chemically synthesized
cucaccuacuuaauccuac

SEQ ID NO: 2783 - RNA, 19 nt, artificial
  Chemically synthesized
aucuggacggugaguuuca

SEQ ID NO: 2784 - RNA, 19 nt, artificial
  Chemically synthesized
aguaucaguaacaggauca

SEQ ID NO: 2785 - RNA, 19 nt, artificial
  Chemically synthesized
uacuacccaaucaugaaau

SEQ ID NO: 2786 - RNA, 19 nt, artificial
  Chemically synthesized
ugagcuuauaaaggcaucu

SEQ ID NO: 2787 - RNA, 19 nt, artificial
  Chemically synthesized
aaauauuaccucguugagg

SEQ ID NO: 2788 - RNA, 19 nt, artificial
  Chemically synthesized
ugaaccuuuggagcuuaac

SEQ ID NO: 2789 - RNA, 19 nt, artificial
  Chemically synthesized
aguggagcuaauagcuagg

SEQ ID NO: 2790 - RNA, 19 nt, artificial
  Chemically synthesized
ugaauacaucugucccuac

SEQ ID NO: 2791 - RNA, 19 nt, artificial
  Chemically synthesized
augaaugugaaacacagaa

SEQ ID NO: 2792 - RNA, 19 nt, artificial
  Chemically synthesized
gucuauuaccaagccuacc

SEQ ID NO: 2793 - RNA, 19 nt, artificial
  Chemically synthesized
aguaacaggaucacaccug

SEQ ID NO: 2794 - RNA, 19 nt, artificial
  Chemically synthesized
uuagcugacuagcugaaua

SEQ ID NO: 2795 - RNA, 19 nt, artificial
  Chemically synthesized
uuccaagcauuugaagagu

SEQ ID NO: 2796 - RNA, 19 nt, artificial
  Chemically synthesized
agucccugaagcuagucca

SEQ ID NO: 2797 - RNA, 19 nt, artificial
  Chemically synthesized
auuuccaaguucacgugca

SEQ ID NO: 2798 - RNA, 19 nt, artificial
  Chemically synthesized
caacaguucuacaucgaug

SEQ ID NO: 2799 - RNA, 19 nt, artificial
  Chemically synthesized
uaaacacaaguguaagcuc

SEQ ID NO: 2800 - RNA, 19 nt, artificial
  Chemically synthesized
uugcuaugaaugugaaaca

SEQ ID NO: 2801 - RNA, 19 nt, artificial
  Chemically synthesized
uuaaaacauuagagugagg

SEQ ID NO: 2802 - RNA, 19 nt, artificial
  Chemically synthesized
aaaggccagaaaaucagcc

SEQ ID NO: 2803 - RNA, 19 nt, artificial
  Chemically synthesized
agauacuucaauucccaga

SEQ ID NO: 2804 - RNA, 19 nt, artificial
  Chemically synthesized
acaaguguaagcucaaaag

SEQ ID NO: 2805 - RNA, 19 nt, artificial
  Chemically synthesized
aagucaccaagaaacagug

SEQ ID NO: 2806 - RNA, 19 nt, artificial
  Chemically synthesized
acacuggcuaauuugaaca

SEQ ID NO: 2807 - RNA, 19 nt, artificial
  Chemically synthesized
ugccguaauauuucucauu

SEQ ID NO: 2808 - RNA, 19 nt, artificial
  Chemically synthesized
augagauaacacugccaug

SEQ ID NO: 2809 - RNA, 19 nt, artificial
  Chemically synthesized
cauuuuguaagcauaacag

SEQ ID NO: 2810 - RNA, 19 nt, artificial
  Chemically synthesized
acagcaaggauaugaaagc

SEQ ID NO: 2811 - RNA, 19 nt, artificial
  Chemically synthesized
acuacaaaugacuuuagcu

SEQ ID NO: 2812 - RNA, 19 nt, artificial
  Chemically synthesized
uaugaaugugaaacacaga

SEQ ID NO: 2813 - RNA, 19 nt, artificial
  Chemically synthesized
uguuagaacacuggcuaau

SEQ ID NO: 2814 - RNA, 19 nt, artificial
  Chemically synthesized
acucaaaugggcuucuacu

SEQ ID NO: 2815 - RNA, 19 nt, artificial
  Chemically synthesized
aacaccaggaugaauacau

SEQ ID NO: 2816 - RNA, 19 nt, artificial
  Chemically synthesized
uggaagaguaaucaacuac

SEQ ID NO: 2817 - RNA, 19 nt, artificial
  Chemically synthesized
uccuauccagcuuuuuaca

SEQ ID NO: 2818 - RNA, 19 nt, artificial
  Chemically synthesized
acaauagacaugcaaaaca

SEQ ID NO: 2819 - RNA, 19 nt, artificial
  Chemically synthesized
ucuuuccaagcauuugaag

SEQ ID NO: 2820 - RNA, 19 nt, artificial
  Chemically synthesized
uuagcugcaguugcuauga

SEQ ID NO: 2821 - RNA, 19 nt, artificial
  Chemically synthesized
aguuucauucucuaggcug

SEQ ID NO: 2822 - RNA, 19 nt, artificial
  Chemically synthesized
uuccauuauugccguaaua

SEQ ID NO: 2823 - RNA, 19 nt, artificial
  Chemically synthesized
agaaacacagugaaccuuu

SEQ ID NO: 2824 - RNA, 19 nt, artificial
  Chemically synthesized
ucccaguagucaaaaucac

SEQ ID NO: 2825 - RNA, 19 nt, artificial
  Chemically synthesized
ugggcuucuacuuuugcuu

SEQ ID NO: 2826 - RNA, 19 nt, artificial
  Chemically synthesized
auagcuagggcaggaaacc

SEQ ID NO: 2827 - RNA, 19 nt, artificial
  Chemically synthesized
aaacacagaaagaaaagag

SEQ ID NO: 2828 - RNA, 19 nt, artificial
  Chemically synthesized
uggagcuaauagcuagggc

SEQ ID NO: 2829 - RNA, 19 nt, artificial
  Chemically synthesized
agcaauucugaaaugcugg

SEQ ID NO: 2830 - RNA, 19 nt, artificial
  Chemically synthesized
uacuaaagaaaaagucccu

SEQ ID NO: 2831 - RNA, 19 nt, artificial
  Chemically synthesized
agaaaagagacuacauuug

SEQ ID NO: 2832 - RNA, 19 nt, artificial
  Chemically synthesized
caacauugauuuaucuugg

SEQ ID NO: 2833 - RNA, 19 nt, artificial
  Chemically synthesized
uccagcuuuuuacauacau

SEQ ID NO: 2834 - RNA, 19 nt, artificial
  Chemically synthesized
ggcaucuaaaacaacaccg

SEQ ID NO: 2835 - RNA, 19 nt, artificial
  Chemically synthesized
ccaagguggaaaaaaucug

SEQ ID NO: 2836 - RNA, 19 nt, artificial
  Chemically synthesized
aaaugggcuucuacuuuug

SEQ ID NO: 2837 - RNA, 19 nt, artificial
  Chemically synthesized
ucuuggcccaauucuauaa

SEQ ID NO: 2838 - RNA, 19 nt, artificial
  Chemically synthesized
accuacuuaauccuaccuu

SEQ ID NO: 2839 - RNA, 19 nt, artificial
  Chemically synthesized
aaccugaauaagcuccuua

SEQ ID NO: 2840 - RNA, 19 nt, artificial
  Chemically synthesized
aaggcaucuaaaacaacac

SEQ ID NO: 2841 - RNA, 19 nt, artificial
  Chemically synthesized
aauagcuagggcaggaaac

SEQ ID NO: 2842 - RNA, 19 nt, artificial
  Chemically synthesized
uaugaaagccuugcugaau

SEQ ID NO: 2843 - RNA, 19 nt, artificial
  Chemically synthesized
ccuaccugaaaccaaauug

SEQ ID NO: 2844 - RNA, 19 nt, artificial
  Chemically synthesized
uaaaggcaucuaaaacaac

SEQ ID NO: 2845 - RNA, 19 nt, artificial
  Chemically synthesized
auaucuccauagccaaugc

SEQ ID NO: 2846 - RNA, 19 nt, artificial
  Chemically synthesized
cucugggucaguuucucag

SEQ ID NO: 2847 - RNA, 19 nt, artificial
  Chemically synthesized
ucaccauuuuguaagcaua

SEQ ID NO: 2848 - RNA, 19 nt, artificial
  Chemically synthesized
ugagcaaccaaguuuaguu

SEQ ID NO: 2849 - RNA, 19 nt, artificial
  Chemically synthesized
uaguaucuuuccaagcauu

SEQ ID NO: 2850 - RNA, 19 nt, artificial
  Chemically synthesized
ugcuuugauuuggacagac

SEQ ID NO: 2851 - RNA, 19 nt, Artificial Sequence
  Chemically synthesized
auagccacaguccagcaau

SEQ ID NO: 2852 - RNA, 21 nt, artificial
  Chemically synthesized
gccaguguucuaacaaacuaa

SEQ ID NO: 2853 - RNA, 21 nt, artificial
  Chemically synthesized
ggauggaauagguaagcaaaa

SEQ ID NO: 2854 - RNA, 21 nt, artificial
  Chemically synthesized
ggauuaaguaggugaguuuaa

SEQ ID NO: 2855 - RNA, 21 nt, artificial
  Chemically synthesized
ccaccugcccuaaauaagaaa

SEQ ID NO: 2856 - RNA, 21 nt, artificial
  Chemically synthesized
caguguucuaacaaacuaaac

SEQ ID NO: 2857 - RNA, 21 nt, artificial
  Chemically synthesized
cagugauugaaggguccuaaa

SEQ ID NO: 2858 - RNA, 21 nt, artificial
  Chemically synthesized
gcuggagaacugucuguccaa

SEQ ID NO: 2859 - RNA, 21 nt, artificial
  Chemically synthesized
gagugaaugaugaauaccugu

SEQ ID NO: 2860 - RNA, 21 nt, artificial
  Chemically synthesized
ggauuucgacuuguuaagaaa

SEQ ID NO: 2861 - RNA, 21 nt, artificial
  Chemically synthesized
ggaaauuaguucugagaucua

SEQ ID NO: 2862 - RNA, 21 nt, artificial
  Chemically synthesized
acgugaacuuggaaauugaaa

SEQ ID NO: 2863 - RNA, 21 nt, artificial
  Chemically synthesized
uagccaguguucuaacaaacu

SEQ ID NO: 2864 - RNA, 21 nt, artificial
  Chemically synthesized
cauccugguguuacugaaaaa

SEQ ID NO: 2865 - RNA, 21 nt, artificial
  Chemically synthesized
agccaguguucuaacaaacua

SEQ ID NO: 2866 - RNA, 21 nt, artificial
  Chemically synthesized
cgugaacuuggaaauugaaaa

SEQ ID NO: 2867 - RNA, 21 nt, artificial
  Chemically synthesized
ugggcuuuucugggaauugaa

SEQ ID NO: 2868 - RNA, 21 nt, artificial
  Chemically synthesized
ggaaagauacuacaaagccaa

SEQ ID NO: 2869 - RNA, 21 nt, artificial
  Chemically synthesized
cacgugaacuuggaaauugaa

SEQ ID NO: 2870 - RNA, 21 nt, artificial
  Chemically synthesized
gcacgugaacuuggaaauuga

SEQ ID NO: 2871 - RNA, 21 nt, artificial
  Chemically synthesized
ggcuuauggaaggcuguuaaa

SEQ ID NO: 2872 - RNA, 21 nt, artificial
  Chemically synthesized
ggagauaugguuuauaguaca

SEQ ID NO: 2873 - RNA, 21 nt, artificial
  Chemically synthesized
gggauggaauagguaagcaaa

SEQ ID NO: 2874 - RNA, 21 nt, artificial
  Chemically synthesized
caauguuguuuugcaugucua

SEQ ID NO: 2875 - RNA, 21 nt, artificial
  Chemically synthesized
aguacagccuagagaaugaaa

SEQ ID NO: 2876 - RNA, 21 nt, artificial
  Chemically synthesized
cuuuggagaagugauucaaaa

SEQ ID NO: 2877 - RNA, 21 nt, artificial
  Chemically synthesized
ccuuuggagaagugauucaaa

SEQ ID NO: 2878 - RNA, 21 nt, artificial
  Chemically synthesized
cagaauugaaugggauggaau

SEQ ID NO: 2879 - RNA, 21 nt, artificial
  Chemically synthesized
ugggauggaauagguaagcaa

SEQ ID NO: 2880 - RNA, 21 nt, artificial
  Chemically synthesized
ccagauuuuuuccaccuugga

SEQ ID NO: 2881 - RNA, 21 nt, artificial
  Chemically synthesized
gaaggguccuaaaaagggaaa

SEQ ID NO: 2882 - RNA, 21 nt, artificial
  Chemically synthesized
cuuccucacucuaauguuuua

SEQ ID NO: 2883 - RNA, 21 nt, artificial
  Chemically synthesized
gaacugucuguccaaaucaaa

SEQ ID NO: 2884 - RNA, 21 nt, artificial
  Chemically synthesized
caacaauguucaauucagcaa

SEQ ID NO: 2885 - RNA, 21 nt, artificial
  Chemically synthesized
cuagguaagaguaaaugagaa

SEQ ID NO: 2886 - RNA, 21 nt, artificial
  Chemically synthesized
agugauugaaggguccuaaaa

SEQ ID NO: 2887 - RNA, 21 nt, artificial
  Chemically synthesized
gugauugaaggguccuaaaaa

SEQ ID NO: 2888 - RNA, 21 nt, artificial
  Chemically synthesized
gaaugaugaauaccugugagg

SEQ ID NO: 2889 - RNA, 21 nt, artificial
  Chemically synthesized
ccucucugauucacuuaguaa

SEQ ID NO: 2890 - RNA, 21 nt, artificial
  Chemically synthesized
agauuuuuuccaccuuggaua

SEQ ID NO: 2891 - RNA, 21 nt, artificial
  Chemically synthesized
gaauuuagccuccacucaaca

SEQ ID NO: 2892 - RNA, 21 nt, artificial
  Chemically synthesized
gaauagguaagcaaaaguaga

SEQ ID NO: 2893 - RNA, 21 nt, artificial
  Chemically synthesized
ggucguggauaaggagcuuau

SEQ ID NO: 2894 - RNA, 21 nt, artificial
  Chemically synthesized
ggcuugguaauagacuauaua

SEQ ID NO: 2895 - RNA, 21 nt, artificial
  Chemically synthesized
cugucacuagggaauaauaaa

SEQ ID NO: 2896 - RNA, 21 nt, artificial
  Chemically synthesized
cuuggugacuuccucacucua

SEQ ID NO: 2897 - RNA, 21 nt, artificial
  Chemically synthesized
ccuagguaagaguaaaugaga

SEQ ID NO: 2898 - RNA, 21 nt, artificial
  Chemically synthesized
gcuuguggugccauuucagua

SEQ ID NO: 2899 - RNA, 21 nt, artificial
  Chemically synthesized
gaugaauaccugugaggauag

SEQ ID NO: 2900 - RNA, 21 nt, artificial
  Chemically synthesized
ggugugauccuguuacugaua

SEQ ID NO: 2901 - RNA, 21 nt, artificial
  Chemically synthesized
gggucguggauaaggagcuua

SEQ ID NO: 2902 - RNA, 21 nt, artificial
  Chemically synthesized
accuaaaaugucacuguucaa

SEQ ID NO: 2903 - RNA, 21 nt, artificial
  Chemically synthesized
gauccuguuacugauacuaua

SEQ ID NO: 2904 - RNA, 21 nt, artificial
  Chemically synthesized
caaagguccuugucccugaga

SEQ ID NO: 2905 - RNA, 21 nt, artificial
  Chemically synthesized
aaauggugauggcuuauggaa

SEQ ID NO: 2906 - RNA, 21 nt, artificial
  Chemically synthesized
cguagggacagauguauucau

SEQ ID NO: 2907 - RNA, 21 nt, artificial
  Chemically synthesized
auagaauugggccaagauaaa

SEQ ID NO: 2908 - RNA, 21 nt, artificial
  Chemically synthesized
gaaagauacuacaaagccaau

SEQ ID NO: 2909 - RNA, 21 nt, artificial
  Chemically synthesized
gcuucagggacuuuuucuuua

SEQ ID NO: 2910 - RNA, 21 nt, artificial
  Chemically synthesized
caugauuggguaguaaaacua

SEQ ID NO: 2911 - RNA, 21 nt, artificial
  Chemically synthesized
aauuagccaguguucuaacaa

SEQ ID NO: 2912 - RNA, 21 nt, artificial
  Chemically synthesized
ucagguaggcuugguaauaga

SEQ ID NO: 2913 - RNA, 21 nt, artificial
  Chemically synthesized
ugaaugggauggaauagguaa

SEQ ID NO: 2914 - RNA, 21 nt, artificial
  Chemically synthesized
cgguguuguuuuagaugccuu

SEQ ID NO: 2915 - RNA, 21 nt, artificial
  Chemically synthesized
gguuucagguaggcuugguaa

SEQ ID NO: 2916 - RNA, 21 nt, artificial
  Chemically synthesized
gcugauuuucuggccuuugga

SEQ ID NO: 2917 - RNA, 21 nt, artificial
  Chemically synthesized
ccuccacucaacaauguucaa

SEQ ID NO: 2918 - RNA, 21 nt, artificial
  Chemically synthesized
gcuguauacuaccacuuugaa

SEQ ID NO: 2919 - RNA, 21 nt, artificial
  Chemically synthesized
cgaaggaaacagagccguuga

SEQ ID NO: 2920 - RNA, 21 nt, artificial
  Chemically synthesized
ugagcuuacacuuguguuuaa

SEQ ID NO: 2921 - RNA, 21 nt, artificial
  Chemically synthesized
cggcguagggacagauguauu

SEQ ID NO: 2922 - RNA, 21 nt, artificial
  Chemically synthesized
agaauugaaugggauggaaua

SEQ ID NO: 2923 - RNA, 21 nt, artificial
  Chemically synthesized
cagagagccugcuaagugauu

SEQ ID NO: 2924 - RNA, 21 nt, artificial
  Chemically synthesized
uauagaauugggccaagauaa

SEQ ID NO: 2925 - RNA, 21 nt, artificial
  Chemically synthesized
cucaggauuucgacuuguuaa

SEQ ID NO: 2926 - RNA, 21 nt, artificial
  Chemically synthesized
cuucaaaugcuuggaaagaua

SEQ ID NO: 2927 - RNA, 21 nt, artificial
  Chemically synthesized
gguccuaaaaagggaaaauau

SEQ ID NO: 2928 - RNA, 21 nt, artificial
  Chemically synthesized
uggagaacugucuguccaaau

SEQ ID NO: 2929 - RNA, 21 nt, artificial
  Chemically synthesized
gcucaggauuucgacuuguua

SEQ ID NO: 2930 - RNA, 21 nt, artificial
  Chemically synthesized
gagccugcuaagugauuuuga

SEQ ID NO: 2931 - RNA, 21 nt, artificial
  Chemically synthesized
ugaugaauaccugugaggaua

SEQ ID NO: 2932 - RNA, 21 nt, artificial
  Chemically synthesized
gagaauuuagccuccacucaa

SEQ ID NO: 2933 - RNA, 21 nt, artificial
  Chemically synthesized
ggccuuuggagaagugauuca

SEQ ID NO: 2934 - RNA, 21 nt, artificial
  Chemically synthesized
ugaaggguuuuuagacaggaa

SEQ ID NO: 2935 - RNA, 21 nt, artificial
  Chemically synthesized
gaggaaucaacuugccagaau

SEQ ID NO: 2936 - RNA, 21 nt, artificial
  Chemically synthesized
aggauuucgacuuguuaagaa

SEQ ID NO: 2937 - RNA, 21 nt, artificial
  Chemically synthesized
aguuccugacucaaauuugaa

SEQ ID NO: 2938 - RNA, 21 nt, artificial
  Chemically synthesized
acaggaagguaggauuaagua

SEQ ID NO: 2939 - RNA, 21 nt, artificial
  Chemically synthesized
cuugcugugggucguggauaa

SEQ ID NO: 2940 - RNA, 21 nt, artificial
  Chemically synthesized
gcuggauaggauuguguguga

SEQ ID NO: 2941 - RNA, 21 nt, artificial
  Chemically synthesized
uuauguuguuccugaacccaa

SEQ ID NO: 2942 - RNA, 21 nt, artificial
  Chemically synthesized
ccuaaaaugucacuguucaaa

SEQ ID NO: 2943 - RNA, 21 nt, artificial
  Chemically synthesized
gauaggaaauuaguucugaga

SEQ ID NO: 2944 - RNA, 21 nt, artificial
  Chemically synthesized
guuucagguaggcuugguaau

SEQ ID NO: 2945 - RNA, 21 nt, artificial
  Chemically synthesized
gauuuucuggccuuuggagaa

SEQ ID NO: 2946 - RNA, 21 nt, artificial
  Chemically synthesized
cugugaggauaggaaauuagu

SEQ ID NO: 2947 - RNA, 21 nt, artificial
  Chemically synthesized
gguaggcuugguaauagacua

SEQ ID NO: 2948 - RNA, 21 nt, artificial
  Chemically synthesized
gaaugaaacucaccguccaga

SEQ ID NO: 2949 - RNA, 21 nt, artificial
  Chemically synthesized
cguggauaaggagcuuauuca

SEQ ID NO: 2950 - RNA, 21 nt, artificial
  Chemically synthesized
gugaaugaugaauaccuguga

SEQ ID NO: 2951 - RNA, 21 nt, artificial
  Chemically synthesized
aauuuagccuccacucaacaa

SEQ ID NO: 2952 - RNA, 21 nt, artificial
  Chemically synthesized
ggagaagugauucaaaauagu

SEQ ID NO: 2953 - RNA, 21 nt, artificial
  Chemically synthesized
ccaccaguuccugacucaaau

SEQ ID NO: 2954 - RNA, 21 nt, artificial
  Chemically synthesized
uagacaggaagguaggauuaa

SEQ ID NO: 2955 - RNA, 21 nt, artificial
  Chemically synthesized
ugggauuauguuguuccugaa

SEQ ID NO: 2956 - RNA, 21 nt, artificial
  Chemically synthesized
aauugggccaagauaaaucaa

SEQ ID NO: 2957 - RNA, 21 nt, artificial
  Chemically synthesized
ggauaaggagcuuauucaggu

SEQ ID NO: 2958 - RNA, 21 nt, artificial
  Chemically synthesized
auuagccaguguucuaacaaa

SEQ ID NO: 2959 - RNA, 21 nt, artificial
  Chemically synthesized
uggcuauggagauaugguuua

SEQ ID NO: 2960 - RNA, 21 nt, artificial
  Chemically synthesized
guccaaaucaaagcaaacuaa

SEQ ID NO: 2961 - RNA, 21 nt, artificial
  Chemically synthesized
uggauaccugucacuagggaa

SEQ ID NO: 2962 - RNA, 21 nt, artificial
  Chemically synthesized
ccaccuuggauaccugucacu

SEQ ID NO: 2963 - RNA, 21 nt, artificial
  Chemically synthesized
augugcuuaaucucagaugaa

SEQ ID NO: 2964 - RNA, 21 nt, artificial
  Chemically synthesized
ccauugagugaaugaugaaua

SEQ ID NO: 2965 - RNA, 21 nt, artificial
  Chemically synthesized
ccuuuuuccacuaacaguuau

SEQ ID NO: 2966 - RNA, 21 nt, artificial
  Chemically synthesized
ggucaauuuacgaagucugca

SEQ ID NO: 2967 - RNA, 21 nt, artificial
  Chemically synthesized
cccucucugauucacuuagua

SEQ ID NO: 2968 - RNA, 21 nt, artificial
  Chemically synthesized
cuguuguccuuuuuccacuaa

SEQ ID NO: 2969 - RNA, 21 nt, artificial
  Chemically synthesized
ugcuuggaaagauacuacaaa

SEQ ID NO: 2970 - RNA, 21 nt, artificial
  Chemically synthesized
caauucagcaaggcuuucaua

SEQ ID NO: 2971 - RNA, 21 nt, artificial
  Chemically synthesized
gugugugauucuagcgucgua

SEQ ID NO: 2972 - RNA, 21 nt, artificial
  Chemically synthesized
ccugcuaagugauuuugacua

SEQ ID NO: 2973 - RNA, 21 nt, artificial
  Chemically synthesized
cucucuugccuguuaugcuua

SEQ ID NO: 2974 - RNA, 21 nt, artificial
  Chemically synthesized
guuaugcacgugaacuuggaa

SEQ ID NO: 2975 - RNA, 21 nt, artificial
  Chemically synthesized
caaaaguagaagcccauuuga

SEQ ID NO: 2976 - RNA, 21 nt, artificial
  Chemically synthesized
gcuauuagcuccacuucacau

SEQ ID NO: 2977 - RNA, 21 nt, artificial
  Chemically synthesized
aguugauuacucuuccauuga

SEQ ID NO: 2978 - RNA, 21 nt, artificial
  Chemically synthesized
gaauuugguuaaaaugcugga

SEQ ID NO: 2979 - RNA, 21 nt, artificial
  Chemically synthesized
gggcuuuucugggaauugaag

SEQ ID NO: 2980 - RNA, 21 nt, artificial
  Chemically synthesized
uugccuguuaugcuuacaaaa

SEQ ID NO: 2981 - RNA, 21 nt, artificial
  Chemically synthesized
gagguuguguuaugcacguga

SEQ ID NO: 2982 - RNA, 21 nt, artificial
  Chemically synthesized
gaagcccauuugaguuuuaca

SEQ ID NO: 2983 - RNA, 21 nt, artificial
  Chemically synthesized
ggcuuuucugggaauugaagu

SEQ ID NO: 2984 - RNA, 21 nt, artificial
  Chemically synthesized
ccaaauguagucucuuuucuu

SEQ ID NO: 2985 - RNA, 21 nt, artificial
  Chemically synthesized
agcuguauacuaccacuuuga

SEQ ID NO: 2986 - RNA, 21 nt, artificial
  Chemically synthesized
uaaccaugcaugcacccagau

SEQ ID NO: 2987 - RNA, 21 nt, artificial
  Chemically synthesized
cugggauuauguuguuccuga

SEQ ID NO: 2988 - RNA, 21 nt, artificial
  Chemically synthesized
gggcaucgauguagaacuguu

SEQ ID NO: 2989 - RNA, 21 nt, artificial
  Chemically synthesized
cugagaaacugacccagagaa

SEQ ID NO: 2990 - RNA, 21 nt, artificial
  Chemically synthesized
gguguuguuuuagaugccuuu

SEQ ID NO: 2991 - RNA, 21 nt, artificial
  Chemically synthesized
cuggcaguuugagcagcaaga

SEQ ID NO: 2992 - RNA, 21 nt, artificial
  Chemically synthesized
cauuucaccauggcaguguua

SEQ ID NO: 2993 - RNA, 21 nt, artificial
  Chemically synthesized
uuccauugagugaaugaugaa

SEQ ID NO: 2994 - RNA, 21 nt, artificial
  Chemically synthesized
gguuguguuaugcacgugaac

SEQ ID NO: 2995 - RNA, 21 nt, artificial
  Chemically synthesized
caguaaccacgguguuguuuu

SEQ ID NO: 2996 - RNA, 21 nt, artificial
  Chemically synthesized
aggagaacugcucauggacua

SEQ ID NO: 2997 - RNA, 21 nt, artificial
  Chemically synthesized
ccuguucuuaaguguugaaua

SEQ ID NO: 2998 - RNA, 21 nt, artificial
  Chemically synthesized
ucauccugguguuacugaaaa

SEQ ID NO: 2999 - RNA, 21 nt, artificial
  Chemically synthesized
ugaaggguccuaaaaagggaa

SEQ ID NO: 3000 - RNA, 21 nt, artificial
  Chemically synthesized
gcuauggagauaugguuuaua

SEQ ID NO: 3001 - RNA, 21 nt, artificial
  Chemically synthesized
uuagccaguguucuaacaaac

SEQ ID NO: 3002 - RNA, 21 nt, artificial
  Chemically synthesized
ggguuuuuagacaggaaggua

SEQ ID NO: 3003 - RNA, 21 nt, artificial
  Chemically synthesized
ugucuauuguuaagcuccaaa

SEQ ID NO: 3004 - RNA, 21 nt, artificial
  Chemically synthesized
gaauaccugugaggauaggaa

SEQ ID NO: 3005 - RNA, 21 nt, artificial
  Chemically synthesized
ccugucacuagggaauaauaa

SEQ ID NO: 3006 - RNA, 21 nt, artificial
  Chemically synthesized
uauucauccugguguuacuga

SEQ ID NO: 3007 - RNA, 21 nt, artificial
  Chemically synthesized
ggaaucaacuugccagaauuu

SEQ ID NO: 3008 - RNA, 21 nt, artificial
  Chemically synthesized
uguaaaaagcuggauaggauu

SEQ ID NO: 3009 - RNA, 21 nt, artificial
  Chemically synthesized
uggauaggauugugugugauu

SEQ ID NO: 3010 - RNA, 21 nt, artificial
  Chemically synthesized
cuguauacuaccacuuugaau

SEQ ID NO: 3011 - RNA, 21 nt, artificial
  Chemically synthesized
ggauaggaaauuaguucugag

SEQ ID NO: 3012 - RNA, 21 nt, artificial
  Chemically synthesized
aaacuaaacuugguugcucaa

SEQ ID NO: 3013 - RNA, 21 nt, artificial
  Chemically synthesized
cagauuuuuuccaccuuggau

SEQ ID NO: 3014 - RNA, 21 nt, artificial
  Chemically synthesized
aagguaggauuaaguagguga

SEQ ID NO: 3015 - RNA, 21 nt, artificial
  Chemically synthesized
agaacugucuguccaaaucaa

SEQ ID NO: 3016 - RNA, 21 nt, artificial
  Chemically synthesized
cauagaucccauuuuuguaca

SEQ ID NO: 3017 - RNA, 21 nt, artificial
  Chemically synthesized
gauucuagcgucguaccuacu

SEQ ID NO: 3018 - RNA, 21 nt, artificial
  Chemically synthesized
ccagagagccugcuaagugau

SEQ ID NO: 3019 - RNA, 21 nt, artificial
  Chemically synthesized
cacuuaguaaucuauccucuu

SEQ ID NO: 3020 - RNA, 21 nt, artificial
  Chemically synthesized
acuuccucacucuaauguuuu

SEQ ID NO: 3021 - RNA, 21 nt, artificial
  Chemically synthesized
ccugagaaacugacccagaga

SEQ ID NO: 3022 - RNA, 21 nt, artificial
  Chemically synthesized
agguuguguuaugcacgugaa

SEQ ID NO: 3023 - RNA, 21 nt, artificial
  Chemically synthesized
gccuuuggagaagugauucaa

SEQ ID NO: 3024 - RNA, 21 nt, artificial
  Chemically synthesized
gagaacugucuguccaaauca

SEQ ID NO: 3025 - RNA, 21 nt, artificial
  Chemically synthesized
aacucuucaaaugcuuggaaa

SEQ ID NO: 3026 - RNA, 21 nt, artificial
  Chemically synthesized
caacgagguaauauuugagga

SEQ ID NO: 3027 - RNA, 21 nt, artificial
  Chemically synthesized
ggaauagguaagcaaaaguag

SEQ ID NO: 3028 - RNA, 21 nt, artificial
  Chemically synthesized
guguagauuuucugcauagau

SEQ ID NO: 3029 - RNA, 21 nt, artificial
  Chemically synthesized
cacucaacaauguucaauuca

SEQ ID NO: 3030 - RNA, 21 nt, artificial
  Chemically synthesized
ucaacaauguucaauucagca

SEQ ID NO: 3031 - RNA, 21 nt, artificial
  Chemically synthesized
gaauugggccaagauaaauca

SEQ ID NO: 3032 - RNA, 21 nt, artificial
  Chemically synthesized
cuguuaugcuuacaaaauggu

SEQ ID NO: 3033 - RNA, 21 nt, artificial
  Chemically synthesized
gucuguccaaaucaaagcaaa

SEQ ID NO: 3034 - RNA, 21 nt, artificial
  Chemically synthesized
ggaauugaaguaucucuccuu

SEQ ID NO: 3035 - RNA, 21 nt, artificial
  Chemically synthesized
gaagucugcauuggcuaugga

SEQ ID NO: 3036 - RNA, 21 nt, artificial
  Chemically synthesized
cucucugauucacuuaguaau

SEQ ID NO: 3037 - RNA, 21 nt, artificial
  Chemically synthesized
agucccucucugauucacuua

SEQ ID NO: 3038 - RNA, 21 nt, artificial
  Chemically synthesized
ggguccuaaaaagggaaaaua

SEQ ID NO: 3039 - RNA, 21 nt, artificial
  Chemically synthesized
caaccucaacgagguaauauu

SEQ ID NO: 3040 - RNA, 21 nt, artificial
  Chemically synthesized
cuauucagcuagucagcuaaa

SEQ ID NO: 3041 - RNA, 21 nt, artificial
  Chemically synthesized
gauuggaacaacagugauuga

SEQ ID NO: 3042 - RNA, 21 nt, artificial
  Chemically synthesized
agaucuagucccucucugauu

SEQ ID NO: 3043 - RNA, 21 nt, artificial
  Chemically synthesized
uuacgaagucugcauuggcua

SEQ ID NO: 3044 - RNA, 21 nt, artificial
  Chemically synthesized
gcuuuucugggaauugaagua

SEQ ID NO: 3045 - RNA, 21 nt, artificial
  Chemically synthesized
gaaggguuuuuagacaggaag

SEQ ID NO: 3046 - RNA, 21 nt, artificial
  Chemically synthesized
ggcuucuugggcaucgaugua

SEQ ID NO: 3047 - RNA, 21 nt, artificial
  Chemically synthesized
ugguugcaacuggcaguuuga

SEQ ID NO: 3048 - RNA, 21 nt, artificial
  Chemically synthesized
accagauuugccuauuuugau

SEQ ID NO: 3049 - RNA, 21 nt, artificial
  Chemically synthesized
uguuaugcacgugaacuugga

SEQ ID NO: 3050 - RNA, 21 nt, artificial
  Chemically synthesized
uggugacuuccucacucuaau

SEQ ID NO: 3051 - RNA, 21 nt, artificial
  Chemically synthesized
caugcacccagauuuuuucca

SEQ ID NO: 3052 - RNA, 21 nt, artificial
  Chemically synthesized
uggcuuauggaaggcuguuaa

SEQ ID NO: 3053 - RNA, 21 nt, artificial
  Chemically synthesized
uguuccugaacccaaccucaa

SEQ ID NO: 3054 - RNA, 21 nt, artificial
  Chemically synthesized
gacaggaagguaggauuaagu

SEQ ID NO: 3055 - RNA, 21 nt, artificial
  Chemically synthesized
cuuaacccuagguaagaguaa

SEQ ID NO: 3056 - RNA, 21 nt, artificial
  Chemically synthesized
cuuuacucacugauuggaaca

SEQ ID NO: 3057 - RNA, 21 nt, artificial
  Chemically synthesized
accaccaguuccugacucaaa

SEQ ID NO: 3058 - RNA, 21 nt, artificial
  Chemically synthesized
gggccaagauaaaucaauguu

SEQ ID NO: 3059 - RNA, 21 nt, artificial
  Chemically synthesized
ugaaacgggucaauuuacgaa

SEQ ID NO: 3060 - RNA, 21 nt, artificial
  Chemically synthesized
caaggcuucuugggcaucgau

SEQ ID NO: 3061 - RNA, 21 nt, artificial
  Chemically synthesized
caccaccaguuccugacucaa

SEQ ID NO: 3062 - RNA, 21 nt, artificial
  Chemically synthesized
ugaggaaucaacuugccagaa

SEQ ID NO: 3063 - RNA, 21 nt, artificial
  Chemically synthesized
aauucagcaaggcuuucauau

SEQ ID NO: 3064 - RNA, 21 nt, artificial
  Chemically synthesized
cuuuauagaauugggccaaga

SEQ ID NO: 3065 - RNA, 21 nt, artificial
  Chemically synthesized
ugaccaugguugcaacuggca

SEQ ID NO: 3066 - RNA, 21 nt, artificial
  Chemically synthesized
ugauuuucuggccuuuggaga

SEQ ID NO: 3067 - RNA, 21 nt, artificial
  Chemically synthesized
uagggaauaauaaaggccuua

SEQ ID NO: 3068 - RNA, 21 nt, artificial
  Chemically synthesized
ccucaacgagguaauauuuga

SEQ ID NO: 3069 - RNA, 21 nt, artificial
  Chemically synthesized
gggaauaauaaaggccuuauu

SEQ ID NO: 3070 - RNA, 21 nt, artificial
  Chemically synthesized
guaggcuugguaauagacuau

SEQ ID NO: 3071 - RNA, 21 nt, artificial
  Chemically synthesized
ugucuguccaaaucaaagcaa

SEQ ID NO: 3072 - RNA, 21 nt, artificial
  Chemically synthesized
cuuguggugccauuucaguaa

SEQ ID NO: 3073 - RNA, 21 nt, artificial
  Chemically synthesized
cccauuuuuguacagaauuga

SEQ ID NO: 3074 - RNA, 21 nt, artificial
  Chemically synthesized
gguaguaaaacuauucagcua

SEQ ID NO: 3075 - RNA, 21 nt, artificial
  Chemically synthesized
uuaugcacgugaacuuggaaa

SEQ ID NO: 3076 - RNA, 21 nt, artificial
  Chemically synthesized
uuggugacuuccucacucuaa

SEQ ID NO: 3077 - RNA, 21 nt, artificial
  Chemically synthesized
uugaaugggauggaauaggua

SEQ ID NO: 3078 - RNA, 21 nt, artificial
  Chemically synthesized
uggaauagguaagcaaaagua

SEQ ID NO: 3079 - RNA, 21 nt, artificial
  Chemically synthesized
aaugcuuggaaagauacuaca

SEQ ID NO: 3080 - RNA, 21 nt, artificial
  Chemically synthesized
uugucaaggguaguagcugua

SEQ ID NO: 3081 - RNA, 21 nt, artificial
  Chemically synthesized
gcuucuccucugguuucagga

SEQ ID NO: 3082 - RNA, 21 nt, artificial
  Chemically synthesized
ggacuagcuucagggacuuuu

SEQ ID NO: 3083 - RNA, 21 nt, artificial
  Chemically synthesized
gguuuuuagacaggaagguag

SEQ ID NO: 3084 - RNA, 21 nt, artificial
  Chemically synthesized
caacuugccagaauuugguua

SEQ ID NO: 3085 - RNA, 21 nt, artificial
  Chemically synthesized
uucuugggcaucgauguagaa

SEQ ID NO: 3086 - RNA, 21 nt, artificial
  Chemically synthesized
uaaccacgguguuguuuuaga

SEQ ID NO: 3087 - RNA, 21 nt, artificial
  Chemically synthesized
ugguuucagguaggcuuggua

SEQ ID NO: 3088 - RNA, 21 nt, artificial
  Chemically synthesized
cuagcuauuagcuccacuuca

SEQ ID NO: 3089 - RNA, 21 nt, artificial
  Chemically synthesized
acugauacuauaagugaccua

SEQ ID NO: 3090 - RNA, 21 nt, artificial
  Chemically synthesized
cuugccagaauuugguuaaaa

SEQ ID NO: 3091 - RNA, 21 nt, artificial
  Chemically synthesized
cccaccugcccuaaauaagaa

SEQ ID NO: 3092 - RNA, 21 nt, artificial
  Chemically synthesized
caggaagguaggauuaaguag

SEQ ID NO: 3093 - RNA, 21 nt, artificial
  Chemically synthesized
cggcuugcgagguuguguuau

SEQ ID NO: 3094 - RNA, 21 nt, artificial
  Chemically synthesized
aauaccugugaggauaggaaa

SEQ ID NO: 3095 - RNA, 21 nt, artificial
  Chemically synthesized
gauaggauugugugugauucu

SEQ ID NO: 3096 - RNA, 21 nt, artificial
  Chemically synthesized
gacucaaauuugaaggguuuu

SEQ ID NO: 3097 - RNA, 21 nt, artificial
  Chemically synthesized
cuugccuguuaugcuuacaaa

SEQ ID NO: 3098 - RNA, 21 nt, artificial
  Chemically synthesized
cagcuagucagcuaaagucau

SEQ ID NO: 3099 - RNA, 21 nt, artificial
  Chemically synthesized
guaccuacuuuugagcuuaca

SEQ ID NO: 3100 - RNA, 21 nt, artificial
  Chemically synthesized
ucaggagaacucugauccuca

SEQ ID NO: 3101 - RNA, 21 nt, artificial
  Chemically synthesized
gagguaauauuugaggaauca

SEQ ID NO: 3102 - RNA, 21 nt, artificial
  Chemically synthesized
cgagguaauauuugaggaauc

SEQ ID NO: 3103 - RNA, 21 nt, artificial
  Chemically synthesized
caauaauggaacugcuucacu

SEQ ID NO: 3104 - RNA, 21 nt, artificial
  Chemically synthesized
aaagguccuugucccugagaa

SEQ ID NO: 3105 - RNA, 21 nt, artificial
  Chemically synthesized
uagcgucguaccuacuuuuga

SEQ ID NO: 3106 - RNA, 21 nt, artificial
  Chemically synthesized
ccagauuugccuauuuugauu

SEQ ID NO: 3107 - RNA, 21 nt, artificial
  Chemically synthesized
cagguuuccugcccuagcuau

SEQ ID NO: 3108 - RNA, 21 nt, artificial
  Chemically synthesized
guuuauaguacagccuagaga

SEQ ID NO: 3109 - RNA, 21 nt, artificial
  Chemically synthesized
gacagauguauucauccuggu

SEQ ID NO: 3110 - RNA, 21 nt, artificial
  Chemically synthesized
guguucuaacaaacuaaacuc

SEQ ID NO: 3111 - RNA, 21 nt, artificial
  Chemically synthesized
ggaagguaggauuaaguaggu

SEQ ID NO: 3112 - RNA, 21 nt, artificial
  Chemically synthesized
aacgagguaauauuugaggaa

SEQ ID NO: 3113 - RNA, 21 nt, artificial
  Chemically synthesized
uaguacagccuagagaaugaa

SEQ ID NO: 3114 - RNA, 21 nt, artificial
  Chemically synthesized
agcucaggauuucgacuuguu

SEQ ID NO: 3115 - RNA, 21 nt, artificial
  Chemically synthesized
cagguaggcuugguaauagac

SEQ ID NO: 3116 - RNA, 21 nt, artificial
  Chemically synthesized
aaggguccuaaaaagggaaaa

SEQ ID NO: 3117 - RNA, 21 nt, artificial
  Chemically synthesized
agaucccauuuuuguacagaa

SEQ ID NO: 3118 - RNA, 21 nt, artificial
  Chemically synthesized
gcuuaaucucagaugaaccau

SEQ ID NO: 3119 - RNA, 21 nt, artificial
  Chemically synthesized
ggauaccugucacuagggaau

SEQ ID NO: 3120 - RNA, 21 nt, artificial
  Chemically synthesized
caccaguuccugacucaaauu

SEQ ID NO: 3121 - RNA, 21 nt, artificial
  Chemically synthesized
cuuccauugagugaaugauga

SEQ ID NO: 3122 - RNA, 21 nt, artificial
  Chemically synthesized
cuuugaauuauugaaacgggu

SEQ ID NO: 3123 - RNA, 21 nt, artificial
  Chemically synthesized
gccugcuaagugauuuugacu

SEQ ID NO: 3124 - RNA, 21 nt, artificial
  Chemically synthesized
caaauuagccaguguucuaac

SEQ ID NO: 3125 - RNA, 21 nt, artificial
  Chemically synthesized
cuuugacucucuugccuguua

SEQ ID NO: 3126 - RNA, 21 nt, artificial
  Chemically synthesized
caggugugauccuguuacuga

SEQ ID NO: 3127 - RNA, 21 nt, artificial
  Chemically synthesized
aacuuuacucacugauuggaa

SEQ ID NO: 3128 - RNA, 21 nt, artificial
  Chemically synthesized
uccuugucccugagaaacuga

SEQ ID NO: 3129 - RNA, 21 nt, artificial
  Chemically synthesized
aaaauggugauggcuuaugga

SEQ ID NO: 3130 - RNA, 21 nt, artificial
  Chemically synthesized
aaauuagccaguguucuaaca

SEQ ID NO: 3131 - RNA, 21 nt, artificial
  Chemically synthesized
gaaugggauggaauagguaag

SEQ ID NO: 3132 - RNA, 21 nt, artificial
  Chemically synthesized
gcuuauggaaggcuguuaaau

SEQ ID NO: 3133 - RNA, 21 nt, artificial
  Chemically synthesized
aaggguaguagcuguauacua

SEQ ID NO: 3134 - RNA, 21 nt, artificial
  Chemically synthesized
ugaaacucaccguccagauaa

SEQ ID NO: 3135 - RNA, 21 nt, artificial
  Chemically synthesized
cuagcuucagggacuuuuucu

SEQ ID NO: 3136 - RNA, 21 nt, artificial
  Chemically synthesized
uacucacugauuggaacaaca

SEQ ID NO: 3137 - RNA, 21 nt, artificial
  Chemically synthesized
aagugauuuugacuacuggga

SEQ ID NO: 3138 - RNA, 21 nt, artificial
  Chemically synthesized
ggcaauaauggaacugcuuca

SEQ ID NO: 3139 - RNA, 21 nt, artificial
  Chemically synthesized
ggguaguaaaacuauucagcu

SEQ ID NO: 3140 - RNA, 21 nt, artificial
  Chemically synthesized
cugcauagaucccauuuuugu

SEQ ID NO: 3141 - RNA, 21 nt, artificial
  Chemically synthesized
guuuuaaagaggcaacaaaag

SEQ ID NO: 3142 - RNA, 21 nt, artificial
  Chemically synthesized
gaacccaaccucaacgaggua

SEQ ID NO: 3143 - RNA, 21 nt, artificial
  Chemically synthesized
agcuauuagcuccacuucaca

SEQ ID NO: 3144 - RNA, 21 nt, artificial
  Chemically synthesized
cuuucuguguuucacauucau

SEQ ID NO: 3145 - RNA, 21 nt, artificial
  Chemically synthesized
cagaauugcuggacuguggcu

SEQ ID NO: 3146 - RNA, 21 nt, artificial
  Chemically synthesized
caaacuaaacuugguugcuca

SEQ ID NO: 3147 - RNA, 21 nt, artificial
  Chemically synthesized
cuucuugggcaucgauguaga

SEQ ID NO: 3148 - RNA, 21 nt, artificial
  Chemically synthesized
gucaaggguaguagcuguaua

SEQ ID NO: 3149 - RNA, 21 nt, artificial
  Chemically synthesized
ucagguuuccugcccuagcua

SEQ ID NO: 3150 - RNA, 21 nt, artificial
  Chemically synthesized
cgauguagaacuguuguccuu

SEQ ID NO: 3151 - RNA, 21 nt, artificial
  Chemically synthesized
ugggcaucgauguagaacugu

SEQ ID NO: 3152 - RNA, 21 nt, artificial
  Chemically synthesized
gguaguagcuguauacuacca

SEQ ID NO: 3153 - RNA, 21 nt, artificial
  Chemically synthesized
cucuuuucuuucuguguuuca

SEQ ID NO: 3154 - RNA, 21 nt, artificial
  Chemically synthesized
cuggagaacugucuguccaaa

SEQ ID NO: 3155 - RNA, 21 nt, artificial
  Chemically synthesized
uugucaccacugacugggcaa

SEQ ID NO: 3156 - RNA, 21 nt, artificial
  Chemically synthesized
ccaaaucaaagcaaacuaaac

SEQ ID NO: 3157 - RNA, 21 nt, artificial
  Chemically synthesized
gcuuggaaagauacuacaaag

SEQ ID NO: 3158 - RNA, 21 nt, artificial
  Chemically synthesized
ggcaguguuaucucaucucug

SEQ ID NO: 3159 - RNA, 21 nt, artificial
  Chemically synthesized
acagaauugaaugggauggaa

SEQ ID NO: 3160 - RNA, 21 nt, artificial
  Chemically synthesized
cacugauuggaacaacaguga

SEQ ID NO: 3161 - RNA, 21 nt, artificial
  Chemically synthesized
gcuuaacccuagguaagagua

SEQ ID NO: 3162 - RNA, 21 nt, artificial
  Chemically synthesized
ucuugccuguuaugcuuacaa

SEQ ID NO: 3163 - RNA, 21 nt, artificial
  Chemically synthesized
cacuaacaguuaucuuugacu

SEQ ID NO: 3164 - RNA, 21 nt, artificial
  Chemically synthesized
gagagccugcuaagugauuuu

SEQ ID NO: 3165 - RNA, 21 nt, artificial
  Chemically synthesized
acaccaccaguuccugacuca

SEQ ID NO: 3166 - RNA, 21 nt, artificial
  Chemically synthesized
gauuauuucaugauuggguag

SEQ ID NO: 3167 - RNA, 21 nt, artificial
  Chemically synthesized
augcuuggaaagauacuacaa

SEQ ID NO: 3168 - RNA, 21 nt, artificial
  Chemically synthesized
ugcauagaucccauuuuugua

SEQ ID NO: 3169 - RNA, 21 nt, artificial
  Chemically synthesized
uaggcuugguaauagacuaua

SEQ ID NO: 3170 - RNA, 21 nt, artificial
  Chemically synthesized
ugauuuugacuacugggauua

SEQ ID NO: 3171 - RNA, 21 nt, artificial
  Chemically synthesized
ugguuuauaguacagccuaga

SEQ ID NO: 3172 - RNA, 21 nt, artificial
  Chemically synthesized
cugcauuggcuauggagauau

SEQ ID NO: 3173 - RNA, 21 nt, artificial
  Chemically synthesized
uuauagaauugggccaagaua

SEQ ID NO: 3174 - RNA, 21 nt, artificial
  Chemically synthesized
gauacuacaaagccaaucuuu

SEQ ID NO: 3175 - RNA, 21 nt, artificial
  Chemically synthesized
cagcaaggcuuucauauccuu

SEQ ID NO: 3176 - RNA, 21 nt, artificial
  Chemically synthesized
gaauugcuggacuguggcuau

SEQ ID NO: 3177 - RNA, 21 nt, artificial
  Chemically synthesized
caggauuucgacuuguuaaga

SEQ ID NO: 3178 - RNA, 21 nt, artificial
  Chemically synthesized
gguccuugucccugagaaacu

SEQ ID NO: 3179 - RNA, 21 nt, artificial
  Chemically synthesized
ugguguuacugaaaaacaggu

SEQ ID NO: 3180 - RNA, 21 nt, artificial
  Chemically synthesized
agugaaugaugaauaccugug

SEQ ID NO: 3181 - RNA, 21 nt, artificial
  Chemically synthesized
caguuaucuuugacucucuug

SEQ ID NO: 3182 - RNA, 21 nt, artificial
  Chemically synthesized
acggcaauaauggaacugcuu

SEQ ID NO: 3183 - RNA, 21 nt, artificial
  Chemically synthesized
auuugaggaaucaacuugcca

SEQ ID NO: 3184 - RNA, 21 nt, artificial
  Chemically synthesized
ccaaccucaacgagguaauau

SEQ ID NO: 3185 - RNA, 21 nt, artificial
  Chemically synthesized
cccuguucuuaaguguugaau

SEQ ID NO: 3186 - RNA, 21 nt, artificial
  Chemically synthesized
gaaccauuucaccauggcagu

SEQ ID NO: 3187 - RNA, 21 nt, artificial
  Chemically synthesized
cagccuagagaaugaaacuca

SEQ ID NO: 3188 - RNA, 21 nt, artificial
  Chemically synthesized
agccuaucaaaacuuccaaaa

SEQ ID NO: 3189 - RNA, 21 nt, artificial
  Chemically synthesized
cuugcgagguuguguuaugca

SEQ ID NO: 3190 - RNA, 21 nt, artificial
  Chemically synthesized
uagaagcccauuugaguuuua

SEQ ID NO: 3191 - RNA, 21 nt, artificial
  Chemically synthesized
accugucacuagggaauaaua

SEQ ID NO: 3192 - RNA, 21 nt, artificial
  Chemically synthesized
agucagcuaaagucauuugua

SEQ ID NO: 3193 - RNA, 21 nt, artificial
  Chemically synthesized
caguauuacaugugcuuaauc

SEQ ID NO: 3194 - RNA, 21 nt, artificial
  Chemically synthesized
cacccagauuuuuuccaccuu

SEQ ID NO: 3195 - RNA, 21 nt, artificial
  Chemically synthesized
cuuacaaaauggugauggcuu

SEQ ID NO: 3196 - RNA, 21 nt, artificial
  Chemically synthesized
uuugguuaaaaugcuggagaa

SEQ ID NO: 3197 - RNA, 21 nt, artificial
  Chemically synthesized
gauuacucuuccauugaguga

SEQ ID NO: 3198 - RNA, 21 nt, artificial
  Chemically synthesized
caugucuauuguuaagcucca

SEQ ID NO: 3199 - RNA, 21 nt, artificial
  Chemically synthesized
gcguagggacagauguauuca

SEQ ID NO: 3200 - RNA, 21 nt, artificial
  Chemically synthesized
agccguugaccaugguugcaa

SEQ ID NO: 3201 - RNA, 21 nt, artificial
  Chemically synthesized
uuacaugugcuuaaucucaga

SEQ ID NO: 3202 - RNA, 21 nt, artificial
  Chemically synthesized
aucucugggcuuuucugggaa

SEQ ID NO: 3203 - RNA, 21 nt, artificial
  Chemically synthesized
ccuugucccugagaaacugac

SEQ ID NO: 3204 - RNA, 21 nt, artificial
  Chemically synthesized
uagaauugggccaagauaaau

SEQ ID NO: 3205 - RNA, 21 nt, artificial
  Chemically synthesized
agggacuuuuucuuuaguaga

SEQ ID NO: 3206 - RNA, 21 nt, artificial
  Chemically synthesized
uugagugaaugaugaauaccu

SEQ ID NO: 3207 - RNA, 21 nt, artificial
  Chemically synthesized
gcaucgauguagaacuguugu

SEQ ID NO: 3208 - RNA, 21 nt, artificial
  Chemically synthesized
uugaaacgggucaauuuacga

SEQ ID NO: 3209 - RNA, 21 nt, artificial
  Chemically synthesized
aagucugcauuggcuauggag

SEQ ID NO: 3210 - RNA, 21 nt, artificial
  Chemically synthesized
augucuauuguuaagcuccaa

SEQ ID NO: 3211 - RNA, 21 nt, artificial
  Chemically synthesized
auugggccaagauaaaucaau

SEQ ID NO: 3212 - RNA, 21 nt, artificial
  Chemically synthesized
ugcuuaaucucagaugaacca

SEQ ID NO: 3213 - RNA, 21 nt, artificial
  Chemically synthesized
cagcuaaagucauuuguaguu

SEQ ID NO: 3214 - RNA, 21 nt, artificial
  Chemically synthesized
gagaauugcucaagauguccu

SEQ ID NO: 3215 - RNA, 21 nt, artificial
  Chemically synthesized
ggcuauggagauaugguuuau

SEQ ID NO: 3216 - RNA, 21 nt, artificial
  Chemically synthesized
gcccuagcuauuagcuccacu

SEQ ID NO: 3217 - RNA, 21 nt, artificial
  Chemically synthesized
cagcauuucagaauugcugga

SEQ ID NO: 3218 - RNA, 21 nt, artificial
  Chemically synthesized
ccuacuuuugagcuuacacuu

SEQ ID NO: 3219 - RNA, 21 nt, artificial
  Chemically synthesized
ccagagaauugcucaagaugu

SEQ ID NO: 3220 - RNA, 21 nt, artificial
  Chemically synthesized
agguaggcuugguaauagacu

SEQ ID NO: 3221 - RNA, 21 nt, artificial
  Chemically synthesized
gauuuugacuacugggauuau

SEQ ID NO: 3222 - RNA, 21 nt, artificial
  Chemically synthesized
augaugaauaccugugaggau

SEQ ID NO: 3223 - RNA, 21 nt, artificial
  Chemically synthesized
gcuccaaagguucacuguguu

SEQ ID NO: 3224 - RNA, 21 nt, artificial
  Chemically synthesized
ugauccuguuacugauacuau

SEQ ID NO: 3225 - RNA, 21 nt, artificial
  Chemically synthesized
gucaauuuacgaagucugcau

SEQ ID NO: 3226 - RNA, 21 nt, artificial
  Chemically synthesized
ggaaacagagccguugaccau

SEQ ID NO: 3227 - RNA, 21 nt, artificial
  Chemically synthesized
gaaaaacaggugugauccugu

SEQ ID NO: 3228 - RNA, 21 nt, artificial
  Chemically synthesized
ucagggacuuuuucuuuagua

SEQ ID NO: 3229 - RNA, 21 nt, artificial
  Chemically synthesized
ucaugauuggguaguaaaacu

SEQ ID NO: 3230 - RNA, 21 nt, artificial
  Chemically synthesized
cauggacuagcuucagggacu

SEQ ID NO: 3231 - RNA, 21 nt, artificial
  Chemically synthesized
gcgagguuguguuaugcacgu

SEQ ID NO: 3232 - RNA, 21 nt, artificial
  Chemically synthesized
aacccaaccucaacgagguaa

SEQ ID NO: 3233 - RNA, 21 nt, artificial
  Chemically synthesized
gagauaugguuuauaguacag

SEQ ID NO: 3234 - RNA, 21 nt, artificial
  Chemically synthesized
aggugugauccuguuacugau

SEQ ID NO: 3235 - RNA, 21 nt, artificial
  Chemically synthesized
gagaaacugacccagagaauu

SEQ ID NO: 3236 - RNA, 21 nt, artificial
  Chemically synthesized
agauuuucugcauagauccca

SEQ ID NO: 3237 - RNA, 21 nt, artificial
  Chemically synthesized
aggaaucaacuugccagaauu

SEQ ID NO: 3238 - RNA, 21 nt, artificial
  Chemically synthesized
ccaugcaugcacccagauuuu

SEQ ID NO: 3239 - RNA, 21 nt, artificial
  Chemically synthesized
acuguuguccuuuuuccacua

SEQ ID NO: 3240 - RNA, 21 nt, artificial
  Chemically synthesized
uaacccuagguaagaguaaau

SEQ ID NO: 3241 - RNA, 21 nt, artificial
  Chemically synthesized
auucauccugguguuacugaa

SEQ ID NO: 3242 - RNA, 21 nt, artificial
  Chemically synthesized
agggaauaauaaaggccuuau

SEQ ID NO: 3243 - RNA, 21 nt, artificial
  Chemically synthesized
uuguuaagcuccaaagguuca

SEQ ID NO: 3244 - RNA, 21 nt, artificial
  Chemically synthesized
cugguuucaggagaacucuga

SEQ ID NO: 3245 - RNA, 21 nt, artificial
  Chemically synthesized
uggaaagauacuacaaagcca

SEQ ID NO: 3246 - RNA, 21 nt, artificial
  Chemically synthesized
cucugauccucagcucaggau

SEQ ID NO: 3247 - RNA, 21 nt, artificial
  Chemically synthesized
caacuggcaguuugagcagca

SEQ ID NO: 3248 - RNA, 21 nt, artificial
  Chemically synthesized
uaagcaaaaguagaagcccau

SEQ ID NO: 3249 - RNA, 21 nt, artificial
  Chemically synthesized
gauuuucugcauagaucccau

SEQ ID NO: 3250 - RNA, 21 nt, artificial
  Chemically synthesized
gaguuuuacauuugauuccac

SEQ ID NO: 3251 - RNA, 21 nt, artificial
  Chemically synthesized
cugcccuagcuauuagcucca

SEQ ID NO: 3252 - RNA, 21 nt, artificial
  Chemically synthesized
uccacuaacaguuaucuuuga

SEQ ID NO: 3253 - RNA, 21 nt, artificial
  Chemically synthesized
aggcuugguaauagacuauau

SEQ ID NO: 3254 - RNA, 21 nt, artificial
  Chemically synthesized
aaagcuuguggugccauuuca

SEQ ID NO: 3255 - RNA, 21 nt, artificial
  Chemically synthesized
uagccuaucaaaacuuccaaa

SEQ ID NO: 3256 - RNA, 21 nt, artificial
  Chemically synthesized
gucuuauuccaacuaaguaga

SEQ ID NO: 3257 - RNA, 21 nt, artificial
  Chemically synthesized
ucagcuaaagucauuuguagu

SEQ ID NO: 3258 - RNA, 21 nt, artificial
  Chemically synthesized
caacugcagcuaacaggcuga

SEQ ID NO: 3259 - RNA, 21 nt, artificial
  Chemically synthesized
cgucguaccuacuuuugagcu

SEQ ID NO: 3260 - RNA, 21 nt, artificial
  Chemically synthesized
caacagugauugaaggguccu

SEQ ID NO: 3261 - RNA, 21 nt, artificial
  Chemically synthesized
ggaacugcuucacuguuucuu

SEQ ID NO: 3262 - RNA, 21 nt, artificial
  Chemically synthesized
cccagauuuuuuccaccuugg

SEQ ID NO: 3263 - RNA, 21 nt, artificial
  Chemically synthesized
cuuaaucucagaugaaccauu

SEQ ID NO: 3264 - RNA, 21 nt, artificial
  Chemically synthesized
aaaacaggugugauccuguua

SEQ ID NO: 3265 - RNA, 21 nt, artificial
  Chemically synthesized
ugagaucuagucccucucuga

SEQ ID NO: 3266 - RNA, 21 nt, artificial
  Chemically synthesized
caaagcaaacuaaacuugguu

SEQ ID NO: 3267 - RNA, 21 nt, artificial
  Chemically synthesized
uggcaguuugagcagcaagaa

SEQ ID NO: 3268 - RNA, 21 nt, artificial
  Chemically synthesized
uguuucuuggugacuuccuca

SEQ ID NO: 3269 - RNA, 21 nt, artificial
  Chemically synthesized
uucaaauuagccaguguucua

SEQ ID NO: 3270 - RNA, 21 nt, artificial
  Chemically synthesized
acugcuucacuguuucuuggu

SEQ ID NO: 3271 - RNA, 21 nt, artificial
  Chemically synthesized
gacccagagaauugcucaaga

SEQ ID NO: 3272 - RNA, 21 nt, artificial
  Chemically synthesized
gaauugaaguaucucuccuua

SEQ ID NO: 3273 - RNA, 21 nt, artificial
  Chemically synthesized
aucuagucccucucugauuca

SEQ ID NO: 3274 - RNA, 21 nt, artificial
  Chemically synthesized
ucaaaugcuuggaaagauacu

SEQ ID NO: 3275 - RNA, 21 nt, artificial
  Chemically synthesized
caauugucaaggguaguagcu

SEQ ID NO: 3276 - RNA, 21 nt, artificial
  Chemically synthesized
cugacucaaauuugaaggguu

SEQ ID NO: 3277 - RNA, 21 nt, artificial
  Chemically synthesized
uuacaaaauggugauggcuua

SEQ ID NO: 3278 - RNA, 21 nt, artificial
  Chemically synthesized
ucucugggcuuuucugggaau

SEQ ID NO: 3279 - RNA, 21 nt, artificial
  Chemically synthesized
caaaagcccacaccaccaguu

SEQ ID NO: 3280 - RNA, 21 nt, artificial
  Chemically synthesized
uaggauugugugugauucuag

SEQ ID NO: 3281 - RNA, 21 nt, artificial
  Chemically synthesized
caaaugcuuggaaagauacua

SEQ ID NO: 3282 - RNA, 21 nt, artificial
  Chemically synthesized
ccuguuacugauacuauaagu

SEQ ID NO: 3283 - RNA, 21 nt, artificial
  Chemically synthesized
gcacccagauuuuuuccaccu

SEQ ID NO: 3284 - RNA, 21 nt, artificial
  Chemically synthesized
cucuaauguuuuaaagaggca

SEQ ID NO: 3285 - RNA, 21 nt, artificial
  Chemically synthesized
caguuccugacucaaauuuga

SEQ ID NO: 3286 - RNA, 21 nt, artificial
  Chemically synthesized
gucucuuuucuuucuguguuu

SEQ ID NO: 3287 - RNA, 21 nt, artificial
  Chemically synthesized
uaguguagauuuucugcauag

SEQ ID NO: 3288 - RNA, 21 nt, artificial
  Chemically synthesized
gguaggauuaaguaggugagu

SEQ ID NO: 3289 - RNA, 21 nt, artificial
  Chemically synthesized
gugauucuagcgucguaccua

SEQ ID NO: 3290 - RNA, 21 nt, artificial
  Chemically synthesized
gguuaaaaugcuggagaacug

SEQ ID NO: 3291 - RNA, 21 nt, artificial
  Chemically synthesized
cucagaugaaccauuucacca

SEQ ID NO: 3292 - RNA, 21 nt, artificial
  Chemically synthesized
ugagaaacugacccagagaau

SEQ ID NO: 3293 - RNA, 21 nt, artificial
  Chemically synthesized
acuugguugcucaaagguccu

SEQ ID NO: 3294 - RNA, 21 nt, artificial
  Chemically synthesized
uaggauuaaguaggugaguuu

SEQ ID NO: 3295 - RNA, 21 nt, artificial
  Chemically synthesized
aggauuaaguaggugaguuua

SEQ ID NO: 3296 - RNA, 21 nt, artificial
  Chemically synthesized
uccuuuuuccacuaacaguua

SEQ ID NO: 3297 - RNA, 21 nt, artificial
  Chemically synthesized
gaagccaccugccuguguuua

SEQ ID NO: 3298 - RNA, 21 nt, artificial
  Chemically synthesized
gcuucuugggcaucgauguag

SEQ ID NO: 3299 - RNA, 21 nt, artificial
  Chemically synthesized
cugucuguccaaaucaaagca

SEQ ID NO: 3300 - RNA, 21 nt, artificial
  Chemically synthesized
cuggauaggauugugugugau

SEQ ID NO: 3301 - RNA, 21 nt, artificial
  Chemically synthesized
cugggcuuuucugggaauuga

SEQ ID NO: 3302 - RNA, 21 nt, artificial
  Chemically synthesized
cuaacaguuaucuuugacucu

SEQ ID NO: 3303 - RNA, 21 nt, artificial
  Chemically synthesized
auguaaaaagcuggauaggau

SEQ ID NO: 3304 - RNA, 21 nt, artificial
  Chemically synthesized
ucuccucugguuucaggagaa

SEQ ID NO: 3305 - RNA, 21 nt, artificial
  Chemically synthesized
gauuuuuuccaccuuggauac

SEQ ID NO: 3306 - RNA, 21 nt, artificial
  Chemically synthesized
aacucaccguccagauaacca

SEQ ID NO: 3307 - RNA, 21 nt, artificial
  Chemically synthesized
agugauuuugacuacugggau

SEQ ID NO: 3308 - RNA, 21 nt, artificial
  Chemically synthesized
auggaauagguaagcaaaagu

SEQ ID NO: 3309 - RNA, 21 nt, artificial
  Chemically synthesized
gauggaauagguaagcaaaag

SEQ ID NO: 3310 - RNA, 21 nt, artificial
  Chemically synthesized
gguuuauaguacagccuagag

SEQ ID NO: 3311 - RNA, 21 nt, artificial
  Chemically synthesized
gauugugugugauucuagcgu

SEQ ID NO: 3312 - RNA, 21 nt, artificial
  Chemically synthesized
cggcaauaauggaacugcuuc

SEQ ID NO: 3313 - RNA, 21 nt, artificial
  Chemically synthesized
cuccaaagguucacuguguuu

SEQ ID NO: 3314 - RNA, 21 nt, artificial
  Chemically synthesized
agaagccaccugccuguguuu

SEQ ID NO: 3315 - RNA, 21 nt, artificial
  Chemically synthesized
ugucaaggguaguagcuguau

SEQ ID NO: 3316 - RNA, 21 nt, artificial
  Chemically synthesized
cauugagugaaugaugaauac

SEQ ID NO: 3317 - RNA, 21 nt, artificial
  Chemically synthesized
agguuuccugcccuagcuauu

SEQ ID NO: 3318 - RNA, 21 nt, artificial
  Chemically synthesized
uccugaacccaaccucaacga

SEQ ID NO: 3319 - RNA, 21 nt, artificial
  Chemically synthesized
aguagaagcccauuugaguuu

SEQ ID NO: 3320 - RNA, 21 nt, artificial
  Chemically synthesized
gccuccacucaacaauguuca

SEQ ID NO: 3321 - RNA, 21 nt, artificial
  Chemically synthesized
guuaaaaugcuggagaacugu

SEQ ID NO: 3322 - RNA, 21 nt, artificial
  Chemically synthesized
auaccugugaggauaggaaau

SEQ ID NO: 3323 - RNA, 21 nt, artificial
  Chemically synthesized
uguacagaauugaaugggaug

SEQ ID NO: 3324 - RNA, 21 nt, artificial
  Chemically synthesized
caguguuaucucaucucuggg

SEQ ID NO: 3325 - RNA, 21 nt, artificial
  Chemically synthesized
uggacuagcuucagggacuuu

SEQ ID NO: 3326 - RNA, 21 nt, artificial
  Chemically synthesized
ugugaggauaggaaauuaguu

SEQ ID NO: 3327 - RNA, 21 nt, artificial
  Chemically synthesized
gaggcaacaaaagcuuguggu

SEQ ID NO: 3328 - RNA, 21 nt, artificial
  Chemically synthesized
ucuggccuuuggagaagugau

SEQ ID NO: 3329 - RNA, 21 nt, artificial
  Chemically synthesized
caucucugggcuuuucuggga

SEQ ID NO: 3330 - RNA, 21 nt, artificial
  Chemically synthesized
gagaaugaaacucaccgucca

SEQ ID NO: 3331 - RNA, 21 nt, artificial
  Chemically synthesized
uuuauaguacagccuagagaa

SEQ ID NO: 3332 - RNA, 21 nt, artificial
  Chemically synthesized
agaacuguuguccuuuuucca

SEQ ID NO: 3333 - RNA, 21 nt, artificial
  Chemically synthesized
aacuaaacuugguugcucaaa

SEQ ID NO: 3334 - RNA, 21 nt, artificial
  Chemically synthesized
gugacuuccucacucuaaugu

SEQ ID NO: 3335 - RNA, 21 nt, artificial
  Chemically synthesized
acaaaagcuuguggugccauu

SEQ ID NO: 3336 - RNA, 21 nt, artificial
  Chemically synthesized
cugacccagagaauugcucaa

SEQ ID NO: 3337 - RNA, 21 nt, artificial
  Chemically synthesized
ucaggauuucgacuuguuaag

SEQ ID NO: 3338 - RNA, 21 nt, artificial
  Chemically synthesized
acucuuccauugagugaauga

SEQ ID NO: 3339 - RNA, 21 nt, artificial
  Chemically synthesized
gcuaaagucauuuguaguuug

SEQ ID NO: 3340 - RNA, 21 nt, artificial
  Chemically synthesized
cauuggcuauggagauauggu

SEQ ID NO: 3341 - RNA, 21 nt, artificial
  Chemically synthesized
gaacugcucauggacuagcuu

SEQ ID NO: 3342 - RNA, 21 nt, artificial
  Chemically synthesized
cuugguugcucaaagguccuu

SEQ ID NO: 3343 - RNA, 21 nt, artificial
  Chemically synthesized
gauaccugucacuagggaaua

SEQ ID NO: 3344 - RNA, 21 nt, artificial
  Chemically synthesized
aagguccuugucccugagaaa

SEQ ID NO: 3345 - RNA, 21 nt, artificial
  Chemically synthesized
ggcaguuugagcagcaagaac

SEQ ID NO: 3346 - RNA, 21 nt, artificial
  Chemically synthesized
cuggccuuuggagaagugauu

SEQ ID NO: 3347 - RNA, 21 nt, artificial
  Chemically synthesized
auuggaacaacagugauugaa

SEQ ID NO: 3348 - RNA, 21 nt, artificial
  Chemically synthesized
gauguauucauccugguguua

SEQ ID NO: 3349 - RNA, 21 nt, artificial
  Chemically synthesized
ccguugaccaugguugcaacu

SEQ ID NO: 3350 - RNA, 21 nt, artificial
  Chemically synthesized
cuauauaaaccagauuugccu

SEQ ID NO: 3351 - RNA, 21 nt, artificial
  Chemically synthesized
gauguagaacuguuguccuuu

SEQ ID NO: 3352 - RNA, 21 nt, artificial
  Chemically synthesized
uuaguuuguuagaacacuggc

SEQ ID NO: 3353 - RNA, 21 nt, artificial
  Chemically synthesized
uuuugcuuaccuauuccaucc

SEQ ID NO: 3354 - RNA, 21 nt, artificial
  Chemically synthesized
uuaaacucaccuacuuaaucc

SEQ ID NO: 3355 - RNA, 21 nt, artificial
  Chemically synthesized
uuucuuauuuagggcaggugg

SEQ ID NO: 3356 - RNA, 21 nt, artificial
  Chemically synthesized
guuuaguuuguuagaacacug

SEQ ID NO: 3357 - RNA, 21 nt, artificial
  Chemically synthesized
uuuaggacccuucaaucacug

SEQ ID NO: 3358 - RNA, 21 nt, artificial
  Chemically synthesized
uuggacagacaguucuccagc

SEQ ID NO: 3359 - RNA, 21 nt, artificial
  Chemically synthesized
acagguauucaucauucacuc

SEQ ID NO: 3360 - RNA, 21 nt, artificial
  Chemically synthesized
uuucuuaacaagucgaaaucc

SEQ ID NO: 3361 - RNA, 21 nt, artificial
  Chemically synthesized
uagaucucagaacuaauuucc

SEQ ID NO: 3362 - RNA, 21 nt, artificial
  Chemically synthesized
uuucaauuuccaaguucacgu

SEQ ID NO: 3363 - RNA, 21 nt, artificial
  Chemically synthesized
aguuuguuagaacacuggcua

SEQ ID NO: 3364 - RNA, 21 nt, artificial
  Chemically synthesized
uuuuucaguaacaccaggaug

SEQ ID NO: 3365 - RNA, 21 nt, artificial
  Chemically synthesized
uaguuuguuagaacacuggcu

SEQ ID NO: 3366 - RNA, 21 nt, artificial
  Chemically synthesized
uuuucaauuuccaaguucacg

SEQ ID NO: 3367 - RNA, 21 nt, artificial
  Chemically synthesized
uucaauucccagaaaagccca

SEQ ID NO: 3368 - RNA, 21 nt, artificial
  Chemically synthesized
uuggcuuuguaguaucuuucc

SEQ ID NO: 3369 - RNA, 21 nt, artificial
  Chemically synthesized
uucaauuuccaaguucacgug

SEQ ID NO: 3370 - RNA, 21 nt, artificial
  Chemically synthesized
ucaauuuccaaguucacgugc

SEQ ID NO: 3371 - RNA, 21 nt, artificial
  Chemically synthesized
uuuaacagccuuccauaagcc

SEQ ID NO: 3372 - RNA, 21 nt, artificial
  Chemically synthesized
uguacuauaaaccauaucucc

SEQ ID NO: 3373 - RNA, 21 nt, artificial
  Chemically synthesized
uuugcuuaccuauuccauccc

SEQ ID NO: 3374 - RNA, 21 nt, artificial
  Chemically synthesized
uagacaugcaaaacaacauug

SEQ ID NO: 3375 - RNA, 21 nt, artificial
  Chemically synthesized
uuucauucucuaggcuguacu

SEQ ID NO: 3376 - RNA, 21 nt, artificial
  Chemically synthesized
uuuugaaucacuucuccaaag

SEQ ID NO: 3377 - RNA, 21 nt, artificial
  Chemically synthesized
uuugaaucacuucuccaaagg

SEQ ID NO: 3378 - RNA, 21 nt, artificial
  Chemically synthesized
auuccaucccauucaauucug

SEQ ID NO: 3379 - RNA, 21 nt, artificial
  Chemically synthesized
uugcuuaccuauuccauccca

SEQ ID NO: 3380 - RNA, 21 nt, artificial
  Chemically synthesized
uccaagguggaaaaaaucugg

SEQ ID NO: 3381 - RNA, 21 nt, artificial
  Chemically synthesized
uuucccuuuuuaggacccuuc

SEQ ID NO: 3382 - RNA, 21 nt, artificial
  Chemically synthesized
uaaaacauuagagugaggaag

SEQ ID NO: 3383 - RNA, 21 nt, artificial
  Chemically synthesized
uuugauuuggacagacaguuc

SEQ ID NO: 3384 - RNA, 21 nt, artificial
  Chemically synthesized
uugcugaauugaacauuguug

SEQ ID NO: 3385 - RNA, 21 nt, artificial
  Chemically synthesized
uucucauuuacucuuaccuag

SEQ ID NO: 3386 - RNA, 21 nt, artificial
  Chemically synthesized
uuuuaggacccuucaaucacu

SEQ ID NO: 3387 - RNA, 21 nt, artificial
  Chemically synthesized
uuuuuaggacccuucaaucac

SEQ ID NO: 3388 - RNA, 21 nt, artificial
  Chemically synthesized
ccucacagguauucaucauuc

SEQ ID NO: 3389 - RNA, 21 nt, artificial
  Chemically synthesized
uuacuaagugaaucagagagg

SEQ ID NO: 3390 - RNA, 21 nt, artificial
  Chemically synthesized
uauccaagguggaaaaaaucu

SEQ ID NO: 3391 - RNA, 21 nt, artificial
  Chemically synthesized
uguugaguggaggcuaaauuc

SEQ ID NO: 3392 - RNA, 21 nt, artificial
  Chemically synthesized
ucuacuuuugcuuaccuauuc

SEQ ID NO: 3393 - RNA, 21 nt, artificial
  Chemically synthesized
auaagcuccuuauccacgacc

SEQ ID NO: 3394 - RNA, 21 nt, artificial
  Chemically synthesized
uauauagucuauuaccaagcc

SEQ ID NO: 3395 - RNA, 21 nt, artificial
  Chemically synthesized
uuuauuauucccuagugacag

SEQ ID NO: 3396 - RNA, 21 nt, artificial
  Chemically synthesized
uagagugaggaagucaccaag

SEQ ID NO: 3397 - RNA, 21 nt, artificial
  Chemically synthesized
ucucauuuacucuuaccuagg

SEQ ID NO: 3398 - RNA, 21 nt, artificial
  Chemically synthesized
uacugaaauggcaccacaagc

SEQ ID NO: 3399 - RNA, 21 nt, artificial
  Chemically synthesized
cuauccucacagguauucauc

SEQ ID NO: 3400 - RNA, 21 nt, artificial
  Chemically synthesized
uaucaguaacaggaucacacc

SEQ ID NO: 3401 - RNA, 21 nt, artificial
  Chemically synthesized
uaagcuccuuauccacgaccc

SEQ ID NO: 3402 - RNA, 21 nt, artificial
  Chemically synthesized
uugaacagugacauuuuaggu

SEQ ID NO: 3403 - RNA, 21 nt, artificial
  Chemically synthesized
uauaguaucaguaacaggauc

SEQ ID NO: 3404 - RNA, 21 nt, artificial
  Chemically synthesized
ucucagggacaaggaccuuug

SEQ ID NO: 3405 - RNA, 21 nt, artificial
  Chemically synthesized
uuccauaagccaucaccauuu

SEQ ID NO: 3406 - RNA, 21 nt, artificial
  Chemically synthesized
augaauacaucugucccuacg

SEQ ID NO: 3407 - RNA, 21 nt, artificial
  Chemically synthesized
uuuaucuuggcccaauucuau

SEQ ID NO: 3408 - RNA, 21 nt, artificial
  Chemically synthesized
auuggcuuuguaguaucuuuc

SEQ ID NO: 3409 - RNA, 21 nt, artificial
  Chemically synthesized
uaaagaaaaagucccugaagc

SEQ ID NO: 3410 - RNA, 21 nt, artificial
  Chemically synthesized
uaguuuuacuacccaaucaug

SEQ ID NO: 3411 - RNA, 21 nt, artificial
  Chemically synthesized
uuguuagaacacuggcuaauu

SEQ ID NO: 3412 - RNA, 21 nt, artificial
  Chemically synthesized
ucuauuaccaagccuaccuga

SEQ ID NO: 3413 - RNA, 21 nt, artificial
  Chemically synthesized
uuaccuauuccaucccauuca

SEQ ID NO: 3414 - RNA, 21 nt, artificial
  Chemically synthesized
aaggcaucuaaaacaacaccg

SEQ ID NO: 3415 - RNA, 21 nt, artificial
  Chemically synthesized
uuaccaagccuaccugaaacc

SEQ ID NO: 3416 - RNA, 21 nt, artificial
  Chemically synthesized
uccaaaggccagaaaaucagc

SEQ ID NO: 3417 - RNA, 21 nt, artificial
  Chemically synthesized
uugaacauuguugaguggagg

SEQ ID NO: 3418 - RNA, 21 nt, artificial
  Chemically synthesized
uucaaagugguaguauacagc

SEQ ID NO: 3419 - RNA, 21 nt, artificial
  Chemically synthesized
ucaacggcucuguuuccuucg

SEQ ID NO: 3420 - RNA, 21 nt, artificial
  Chemically synthesized
uuaaacacaaguguaagcuca

SEQ ID NO: 3421 - RNA, 21 nt, artificial
  Chemically synthesized
aauacaucugucccuacgccg

SEQ ID NO: 3422 - RNA, 21 nt, artificial
  Chemically synthesized
uauuccaucccauucaauucu

SEQ ID NO: 3423 - RNA, 21 nt, artificial
  Chemically synthesized
aaucacuuagcaggcucucug

SEQ ID NO: 3424 - RNA, 21 nt, artificial
  Chemically synthesized
uuaucuuggcccaauucuaua

SEQ ID NO: 3425 - RNA, 21 nt, artificial
  Chemically synthesized
uuaacaagucgaaauccugag

SEQ ID NO: 3426 - RNA, 21 nt, artificial
  Chemically synthesized
uaucuuuccaagcauuugaag

SEQ ID NO: 3427 - RNA, 21 nt, artificial
  Chemically synthesized
auauuuucccuuuuuaggacc

SEQ ID NO: 3428 - RNA, 21 nt, artificial
  Chemically synthesized
auuuggacagacaguucucca

SEQ ID NO: 3429 - RNA, 21 nt, artificial
  Chemically synthesized
uaacaagucgaaauccugagc

SEQ ID NO: 3430 - RNA, 21 nt, artificial
  Chemically synthesized
ucaaaaucacuuagcaggcuc

SEQ ID NO: 3431 - RNA, 21 nt, artificial
  Chemically synthesized
uauccucacagguauucauca

SEQ ID NO: 3432 - RNA, 21 nt, artificial
  Chemically synthesized
uugaguggaggcuaaauucuc

SEQ ID NO: 3433 - RNA, 21 nt, artificial
  Chemically synthesized
ugaaucacuucuccaaaggcc

SEQ ID NO: 3434 - RNA, 21 nt, artificial
  Chemically synthesized
uuccugucuaaaaacccuuca

SEQ ID NO: 3435 - RNA, 21 nt, artificial
  Chemically synthesized
auucuggcaaguugauuccuc

SEQ ID NO: 3436 - RNA, 21 nt, artificial
  Chemically synthesized
uucuuaacaagucgaaauccu

SEQ ID NO: 3437 - RNA, 21 nt, artificial
  Chemically synthesized
uucaaauuugagucaggaacu

SEQ ID NO: 3438 - RNA, 21 nt, artificial
  Chemically synthesized
uacuuaauccuaccuuccugu

SEQ ID NO: 3439 - RNA, 21 nt, artificial
  Chemically synthesized
uuauccacgacccacagcaag

SEQ ID NO: 3440 - RNA, 21 nt, artificial
  Chemically synthesized
ucacacacaauccuauccagc

SEQ ID NO: 3441 - RNA, 21 nt, artificial
  Chemically synthesized
uuggguucaggaacaacauaa

SEQ ID NO: 3442 - RNA, 21 nt, artificial
  Chemically synthesized
uuugaacagugacauuuuagg

SEQ ID NO: 3443 - RNA, 21 nt, artificial
  Chemically synthesized
ucucagaacuaauuuccuauc

SEQ ID NO: 3444 - RNA, 21 nt, artificial
  Chemically synthesized
auuaccaagccuaccugaaac

SEQ ID NO: 3445 - RNA, 21 nt, artificial
  Chemically synthesized
uucuccaaaggccagaaaauc

SEQ ID NO: 3446 - RNA, 21 nt, artificial
  Chemically synthesized
acuaauuuccuauccucacag

SEQ ID NO: 3447 - RNA, 21 nt, artificial
  Chemically synthesized
uagucuauuaccaagccuacc

SEQ ID NO: 3448 - RNA, 21 nt, artificial
  Chemically synthesized
ucuggacggugaguuucauuc

SEQ ID NO: 3449 - RNA, 21 nt, artificial
  Chemically synthesized
ugaauaagcuccuuauccacg

SEQ ID NO: 3450 - RNA, 21 nt, artificial
  Chemically synthesized
ucacagguauucaucauucac

SEQ ID NO: 3451 - RNA, 21 nt, artificial
  Chemically synthesized
uuguugaguggaggcuaaauu

SEQ ID NO: 3452 - RNA, 21 nt, artificial
  Chemically synthesized
acuauuuugaaucacuucucc

SEQ ID NO: 3453 - RNA, 21 nt, artificial
  Chemically synthesized
auuugagucaggaacuggugg

SEQ ID NO: 3454 - RNA, 21 nt, artificial
  Chemically synthesized
uuaauccuaccuuccugucua

SEQ ID NO: 3455 - RNA, 21 nt, artificial
  Chemically synthesized
uucaggaacaacauaauccca

SEQ ID NO: 3456 - RNA, 21 nt, artificial
  Chemically synthesized
uugauuuaucuuggcccaauu

SEQ ID NO: 3457 - RNA, 21 nt, artificial
  Chemically synthesized
accugaauaagcuccuuaucc

SEQ ID NO: 3458 - RNA, 21 nt, artificial
  Chemically synthesized
uuuguuagaacacuggcuaau

SEQ ID NO: 3459 - RNA, 21 nt, artificial
  Chemically synthesized
uaaaccauaucuccauagcca

SEQ ID NO: 3460 - RNA, 21 nt, artificial
  Chemically synthesized
uuaguuugcuuugauuuggac

SEQ ID NO: 3461 - RNA, 21 nt, artificial
  Chemically synthesized
uucccuagugacagguaucca

SEQ ID NO: 3462 - RNA, 21 nt, artificial
  Chemically synthesized
agugacagguauccaaggugg

SEQ ID NO: 3463 - RNA, 21 nt, artificial
  Chemically synthesized
uucaucugagauuaagcacau

SEQ ID NO: 3464 - RNA, 21 nt, artificial
  Chemically synthesized
uauucaucauucacucaaugg

SEQ ID NO: 3465 - RNA, 21 nt, artificial
  Chemically synthesized
auaacuguuaguggaaaaagg

SEQ ID NO: 3466 - RNA, 21 nt, artificial
  Chemically synthesized
ugcagacuucguaaauugacc

SEQ ID NO: 3467 - RNA, 21 nt, artificial
  Chemically synthesized
uacuaagugaaucagagaggg

SEQ ID NO: 3468 - RNA, 21 nt, artificial
  Chemically synthesized
uuaguggaaaaaggacaacag

SEQ ID NO: 3469 - RNA, 21 nt, artificial
  Chemically synthesized
uuuguaguaucuuuccaagca

SEQ ID NO: 3470 - RNA, 21 nt, artificial
  Chemically synthesized
uaugaaagccuugcugaauug

SEQ ID NO: 3471 - RNA, 21 nt, artificial
  Chemically synthesized
uacgacgcuagaaucacacac

SEQ ID NO: 3472 - RNA, 21 nt, artificial
  Chemically synthesized
uagucaaaaucacuuagcagg

SEQ ID NO: 3473 - RNA, 21 nt, artificial
  Chemically synthesized
uaagcauaacaggcaagagag

SEQ ID NO: 3474 - RNA, 21 nt, artificial
  Chemically synthesized
uuccaaguucacgugcauaac

SEQ ID NO: 3475 - RNA, 21 nt, artificial
  Chemically synthesized
ucaaaugggcuucuacuuuug

SEQ ID NO: 3476 - RNA, 21 nt, artificial
  Chemically synthesized
augugaaguggagcuaauagc

SEQ ID NO: 3477 - RNA, 21 nt, artificial
  Chemically synthesized
ucaauggaagaguaaucaacu

SEQ ID NO: 3478 - RNA, 21 nt, artificial
  Chemically synthesized
uccagcauuuuaaccaaauuc

SEQ ID NO: 3479 - RNA, 21 nt, artificial
  Chemically synthesized
cuucaauucccagaaaagccc

SEQ ID NO: 3480 - RNA, 21 nt, artificial
  Chemically synthesized
uuuuguaagcauaacaggcaa

SEQ ID NO: 3481 - RNA, 21 nt, artificial
  Chemically synthesized
ucacgugcauaacacaaccuc

SEQ ID NO: 3482 - RNA, 21 nt, artificial
  Chemically synthesized
uguaaaacucaaaugggcuuc

SEQ ID NO: 3483 - RNA, 21 nt, artificial
  Chemically synthesized
acuucaauucccagaaaagcc

SEQ ID NO: 3484 - RNA, 21 nt, artificial
  Chemically synthesized
aagaaaagagacuacauuugg

SEQ ID NO: 3485 - RNA, 21 nt, artificial
  Chemically synthesized
ucaaagugguaguauacagcu

SEQ ID NO: 3486 - RNA, 21 nt, artificial
  Chemically synthesized
aucugggugcaugcaugguua

SEQ ID NO: 3487 - RNA, 21 nt, artificial
  Chemically synthesized
ucaggaacaacauaaucccag

SEQ ID NO: 3488 - RNA, 21 nt, artificial
  Chemically synthesized
aacaguucuacaucgaugccc

SEQ ID NO: 3489 - RNA, 21 nt, artificial
  Chemically synthesized
uucucugggucaguuucucag

SEQ ID NO: 3490 - RNA, 21 nt, artificial
  Chemically synthesized
aaaggcaucuaaaacaacacc

SEQ ID NO: 3491 - RNA, 21 nt, artificial
  Chemically synthesized
ucuugcugcucaaacugccag

SEQ ID NO: 3492 - RNA, 21 nt, artificial
  Chemically synthesized
uaacacugccauggugaaaug

SEQ ID NO: 3493 - RNA, 21 nt, artificial
  Chemically synthesized
uucaucauucacucaauggaa

SEQ ID NO: 3494 - RNA, 21 nt, artificial
  Chemically synthesized
guucacgugcauaacacaacc

SEQ ID NO: 3495 - RNA, 21 nt, artificial
  Chemically synthesized
aaaacaacaccgugguuacug

SEQ ID NO: 3496 - RNA, 21 nt, artificial
  Chemically synthesized
uaguccaugagcaguucuccu

SEQ ID NO: 3497 - RNA, 21 nt, artificial
  Chemically synthesized
uauucaacacuuaagaacagg

SEQ ID NO: 3498 - RNA, 21 nt, artificial
  Chemically synthesized
uuuucaguaacaccaggauga

SEQ ID NO: 3499 - RNA, 21 nt, artificial
  Chemically synthesized
uucccuuuuuaggacccuuca

SEQ ID NO: 3500 - RNA, 21 nt, artificial
  Chemically synthesized
uauaaaccauaucuccauagc

SEQ ID NO: 3501 - RNA, 21 nt, artificial
  Chemically synthesized
guuuguuagaacacuggcuaa

SEQ ID NO: 3502 - RNA, 21 nt, artificial
  Chemically synthesized
uaccuuccugucuaaaaaccc

SEQ ID NO: 3503 - RNA, 21 nt, artificial
  Chemically synthesized
uuuggagcuuaacaauagaca

SEQ ID NO: 3504 - RNA, 21 nt, artificial
  Chemically synthesized
uuccuauccucacagguauuc

SEQ ID NO: 3505 - RNA, 21 nt, artificial
  Chemically synthesized
uuauuauucccuagugacagg

SEQ ID NO: 3506 - RNA, 21 nt, artificial
  Chemically synthesized
ucaguaacaccaggaugaaua

SEQ ID NO: 3507 - RNA, 21 nt, artificial
  Chemically synthesized
aaauucuggcaaguugauucc

SEQ ID NO: 3508 - RNA, 21 nt, artificial
  Chemically synthesized
aauccuauccagcuuuuuaca

SEQ ID NO: 3509 - RNA, 21 nt, artificial
  Chemically synthesized
aaucacacacaauccuaucca

SEQ ID NO: 3510 - RNA, 21 nt, artificial
  Chemically synthesized
auucaaagugguaguauacag

SEQ ID NO: 3511 - RNA, 21 nt, artificial
  Chemically synthesized
cucagaacuaauuuccuaucc

SEQ ID NO: 3512 - RNA, 21 nt, artificial
  Chemically synthesized
uugagcaaccaaguuuaguuu

SEQ ID NO: 3513 - RNA, 21 nt, artificial
  Chemically synthesized
auccaagguggaaaaaaucug

SEQ ID NO: 3514 - RNA, 21 nt, artificial
  Chemically synthesized
ucaccuacuuaauccuaccuu

SEQ ID NO: 3515 - RNA, 21 nt, artificial
  Chemically synthesized
uugauuuggacagacaguucu

SEQ ID NO: 3516 - RNA, 21 nt, artificial
  Chemically synthesized
uguacaaaaaugggaucuaug

SEQ ID NO: 3517 - RNA, 21 nt, artificial
  Chemically synthesized
aguagguacgacgcuagaauc

SEQ ID NO: 3518 - RNA, 21 nt, artificial
  Chemically synthesized
aucacuuagcaggcucucugg

SEQ ID NO: 3519 - RNA, 21 nt, artificial
  Chemically synthesized
aagaggauagauuacuaagug

SEQ ID NO: 3520 - RNA, 21 nt, artificial
  Chemically synthesized
aaaacauuagagugaggaagu

SEQ ID NO: 3521 - RNA, 21 nt, artificial
  Chemically synthesized
ucucugggucaguuucucagg

SEQ ID NO: 3522 - RNA, 21 nt, artificial
  Chemically synthesized
uucacgugcauaacacaaccu

SEQ ID NO: 3523 - RNA, 21 nt, artificial
  Chemically synthesized
uugaaucacuucuccaaaggc

SEQ ID NO: 3524 - RNA, 21 nt, artificial
  Chemically synthesized
ugauuuggacagacaguucuc

SEQ ID NO: 3525 - RNA, 21 nt, artificial
  Chemically synthesized
uuuccaagcauuugaagaguu

SEQ ID NO: 3526 - RNA, 21 nt, artificial
  Chemically synthesized
uccucaaauauuaccucguug

SEQ ID NO: 3527 - RNA, 21 nt, artificial
  Chemically synthesized
cuacuuuugcuuaccuauucc

SEQ ID NO: 3528 - RNA, 21 nt, artificial
  Chemically synthesized
aucuaugcagaaaaucuacac

SEQ ID NO: 3529 - RNA, 21 nt, artificial
  Chemically synthesized
ugaauugaacauuguugagug

SEQ ID NO: 3530 - RNA, 21 nt, artificial
  Chemically synthesized
ugcugaauugaacauuguuga

SEQ ID NO: 3531 - RNA, 21 nt, artificial
  Chemically synthesized
ugauuuaucuuggcccaauuc

SEQ ID NO: 3532 - RNA, 21 nt, artificial
  Chemically synthesized
accauuuuguaagcauaacag

SEQ ID NO: 3533 - RNA, 21 nt, artificial
  Chemically synthesized
uuugcuuugauuuggacagac

SEQ ID NO: 3534 - RNA, 21 nt, artificial
  Chemically synthesized
aaggagagauacuucaauucc

SEQ ID NO: 3535 - RNA, 21 nt, artificial
  Chemically synthesized
uccauagccaaugcagacuuc

SEQ ID NO: 3536 - RNA, 21 nt, artificial
  Chemically synthesized
auuacuaagugaaucagagag

SEQ ID NO: 3537 - RNA, 21 nt, artificial
  Chemically synthesized
uaagugaaucagagagggacu

SEQ ID NO: 3538 - RNA, 21 nt, artificial
  Chemically synthesized
uauuuucccuuuuuaggaccc

SEQ ID NO: 3539 - RNA, 21 nt, artificial
  Chemically synthesized
aauauuaccucguugagguug

SEQ ID NO: 3540 - RNA, 21 nt, artificial
  Chemically synthesized
uuuagcugacuagcugaauag

SEQ ID NO: 3541 - RNA, 21 nt, artificial
  Chemically synthesized
ucaaucacuguuguuccaauc

SEQ ID NO: 3542 - RNA, 21 nt, artificial
  Chemically synthesized
aaucagagagggacuagaucu

SEQ ID NO: 3543 - RNA, 21 nt, artificial
  Chemically synthesized
uagccaaugcagacuucguaa

SEQ ID NO: 3544 - RNA, 21 nt, artificial
  Chemically synthesized
uacuucaauucccagaaaagc

SEQ ID NO: 3545 - RNA, 21 nt, artificial
  Chemically synthesized
cuuccugucuaaaaacccuuc

SEQ ID NO: 3546 - RNA, 21 nt, artificial
  Chemically synthesized
uacaucgaugcccaagaagcc

SEQ ID NO: 3547 - RNA, 21 nt, artificial
  Chemically synthesized
ucaaacugccaguugcaacca

SEQ ID NO: 3548 - RNA, 21 nt, artificial
  Chemically synthesized
aucaaaauaggcaaaucuggu

SEQ ID NO: 3549 - RNA, 21 nt, artificial
  Chemically synthesized
uccaaguucacgugcauaaca

SEQ ID NO: 3550 - RNA, 21 nt, artificial
  Chemically synthesized
auuagagugaggaagucacca

SEQ ID NO: 3551 - RNA, 21 nt, artificial
  Chemically synthesized
uggaaaaaaucugggugcaug

SEQ ID NO: 3552 - RNA, 21 nt, artificial
  Chemically synthesized
uuaacagccuuccauaagcca

SEQ ID NO: 3553 - RNA, 21 nt, artificial
  Chemically synthesized
uugagguuggguucaggaaca

SEQ ID NO: 3554 - RNA, 21 nt, artificial
  Chemically synthesized
acuuaauccuaccuuccuguc

SEQ ID NO: 3555 - RNA, 21 nt, artificial
  Chemically synthesized
uuacucuuaccuaggguuaag

SEQ ID NO: 3556 - RNA, 21 nt, artificial
  Chemically synthesized
uguuccaaucagugaguaaag

SEQ ID NO: 3557 - RNA, 21 nt, artificial
  Chemically synthesized
uuugagucaggaacugguggu

SEQ ID NO: 3558 - RNA, 21 nt, artificial
  Chemically synthesized
aacauugauuuaucuuggccc

SEQ ID NO: 3559 - RNA, 21 nt, artificial
  Chemically synthesized
uucguaaauugacccguuuca

SEQ ID NO: 3560 - RNA, 21 nt, artificial
  Chemically synthesized
aucgaugcccaagaagccuug

SEQ ID NO: 3561 - RNA, 21 nt, artificial
  Chemically synthesized
uugagucaggaacugguggug

SEQ ID NO: 3562 - RNA, 21 nt, artificial
  Chemically synthesized
uucuggcaaguugauuccuca

SEQ ID NO: 3563 - RNA, 21 nt, artificial
  Chemically synthesized
auaugaaagccuugcugaauu

SEQ ID NO: 3564 - RNA, 21 nt, artificial
  Chemically synthesized
ucuuggcccaauucuauaaag

SEQ ID NO: 3565 - RNA, 21 nt, artificial
  Chemically synthesized
ugccaguugcaaccaugguca

SEQ ID NO: 3566 - RNA, 21 nt, artificial
  Chemically synthesized
ucuccaaaggccagaaaauca

SEQ ID NO: 3567 - RNA, 21 nt, artificial
  Chemically synthesized
uaaggccuuuauuauucccua

SEQ ID NO: 3568 - RNA, 21 nt, artificial
  Chemically synthesized
ucaaauauuaccucguugagg

SEQ ID NO: 3569 - RNA, 21 nt, artificial
  Chemically synthesized
aauaaggccuuuauuauuccc

SEQ ID NO: 3570 - RNA, 21 nt, artificial
  Chemically synthesized
auagucuauuaccaagccuac

SEQ ID NO: 3571 - RNA, 21 nt, artificial
  Chemically synthesized
uugcuuugauuuggacagaca

SEQ ID NO: 3572 - RNA, 21 nt, artificial
  Chemically synthesized
uuacugaaauggcaccacaag

SEQ ID NO: 3573 - RNA, 21 nt, artificial
  Chemically synthesized
ucaauucuguacaaaaauggg

SEQ ID NO: 3574 - RNA, 21 nt, artificial
  Chemically synthesized
uagcugaauaguuuuacuacc

SEQ ID NO: 3575 - RNA, 21 nt, artificial
  Chemically synthesized
uuuccaaguucacgugcauaa

SEQ ID NO: 3576 - RNA, 21 nt, artificial
  Chemically synthesized
uuagagugaggaagucaccaa

SEQ ID NO: 3577 - RNA, 21 nt, artificial
  Chemically synthesized
uaccuauuccaucccauucaa

SEQ ID NO: 3578 - RNA, 21 nt, artificial
  Chemically synthesized
uacuuuugcuuaccuauucca

SEQ ID NO: 3579 - RNA, 21 nt, artificial
  Chemically synthesized
uguaguaucuuuccaagcauu

SEQ ID NO: 3580 - RNA, 21 nt, artificial
  Chemically synthesized
uacagcuacuacccuugacaa

SEQ ID NO: 3581 - RNA, 21 nt, artificial
  Chemically synthesized
uccugaaaccagaggagaagc

SEQ ID NO: 3582 - RNA, 21 nt, artificial
  Chemically synthesized
aaaagucccugaagcuagucc

SEQ ID NO: 3583 - RNA, 21 nt, artificial
  Chemically synthesized
cuaccuuccugucuaaaaacc

SEQ ID NO: 3584 - RNA, 21 nt, artificial
  Chemically synthesized
uaaccaaauucuggcaaguug

SEQ ID NO: 3585 - RNA, 21 nt, artificial
  Chemically synthesized
uucuacaucgaugcccaagaa

SEQ ID NO: 3586 - RNA, 21 nt, artificial
  Chemically synthesized
ucuaaaacaacaccgugguua

SEQ ID NO: 3587 - RNA, 21 nt, artificial
  Chemically synthesized
uaccaagccuaccugaaacca

SEQ ID NO: 3588 - RNA, 21 nt, artificial
  Chemically synthesized
ugaaguggagcuaauagcuag

SEQ ID NO: 3589 - RNA, 21 nt, artificial
  Chemically synthesized
uaggucacuuauaguaucagu

SEQ ID NO: 3590 - RNA, 21 nt, artificial
  Chemically synthesized
uuuuaaccaaauucuggcaag

SEQ ID NO: 3591 - RNA, 21 nt, artificial
  Chemically synthesized
uucuuauuuagggcagguggg

SEQ ID NO: 3592 - RNA, 21 nt, artificial
  Chemically synthesized
cuacuuaauccuaccuuccug

SEQ ID NO: 3593 - RNA, 21 nt, artificial
  Chemically synthesized
auaacacaaccucgcaagccg

SEQ ID NO: 3594 - RNA, 21 nt, artificial
  Chemically synthesized
uuuccuauccucacagguauu

SEQ ID NO: 3595 - RNA, 21 nt, artificial
  Chemically synthesized
agaaucacacacaauccuauc

SEQ ID NO: 3596 - RNA, 21 nt, artificial
  Chemically synthesized
aaaacccuucaaauuugaguc

SEQ ID NO: 3597 - RNA, 21 nt, artificial
  Chemically synthesized
uuuguaagcauaacaggcaag

SEQ ID NO: 3598 - RNA, 21 nt, artificial
  Chemically synthesized
augacuuuagcugacuagcug

SEQ ID NO: 3599 - RNA, 21 nt, artificial
  Chemically synthesized
uguaagcucaaaaguagguac

SEQ ID NO: 3600 - RNA, 21 nt, artificial
  Chemically synthesized
ugaggaucagaguucuccuga

SEQ ID NO: 3601 - RNA, 21 nt, artificial
  Chemically synthesized
ugauuccucaaauauuaccuc

SEQ ID NO: 3602 - RNA, 21 nt, artificial
  Chemically synthesized
gauuccucaaauauuaccucg

SEQ ID NO: 3603 - RNA, 21 nt, artificial
  Chemically synthesized
agugaagcaguuccauuauug

SEQ ID NO: 3604 - RNA, 21 nt, artificial
  Chemically synthesized
uucucagggacaaggaccuuu

SEQ ID NO: 3605 - RNA, 21 nt, artificial
  Chemically synthesized
ucaaaaguagguacgacgcua

SEQ ID NO: 3606 - RNA, 21 nt, artificial
  Chemically synthesized
aaucaaaauaggcaaaucugg

SEQ ID NO: 3607 - RNA, 21 nt, artificial
  Chemically synthesized
auagcuagggcaggaaaccug

SEQ ID NO: 3608 - RNA, 21 nt, artificial
  Chemically synthesized
ucucuaggcuguacuauaaac

SEQ ID NO: 3609 - RNA, 21 nt, artificial
  Chemically synthesized
accaggaugaauacaucuguc

SEQ ID NO: 3610 - RNA, 21 nt, artificial
  Chemically synthesized
gaguuuaguuuguuagaacac

SEQ ID NO: 3611 - RNA, 21 nt, artificial
  Chemically synthesized
accuacuuaauccuaccuucc

SEQ ID NO: 3612 - RNA, 21 nt, artificial
  Chemically synthesized
uuccucaaauauuaccucguu

SEQ ID NO: 3613 - RNA, 21 nt, artificial
  Chemically synthesized
uucauucucuaggcuguacua

SEQ ID NO: 3614 - RNA, 21 nt, artificial
  Chemically synthesized
aacaagucgaaauccugagcu

SEQ ID NO: 3615 - RNA, 21 nt, artificial
  Chemically synthesized
gucuauuaccaagccuaccug

SEQ ID NO: 3616 - RNA, 21 nt, artificial
  Chemically synthesized
uuuucccuuuuuaggacccuu

SEQ ID NO: 3617 - RNA, 21 nt, artificial
  Chemically synthesized
uucuguacaaaaaugggaucu

SEQ ID NO: 3618 - RNA, 21 nt, artificial
  Chemically synthesized
augguucaucugagauuaagc

SEQ ID NO: 3619 - RNA, 21 nt, artificial
  Chemically synthesized
auucccuagugacagguaucc

SEQ ID NO: 3620 - RNA, 21 nt, artificial
  Chemically synthesized
aauuugagucaggaacuggug

SEQ ID NO: 3621 - RNA, 21 nt, artificial
  Chemically synthesized
ucaucauucacucaauggaag

SEQ ID NO: 3622 - RNA, 21 nt, artificial
  Chemically synthesized
acccguuucaauaauucaaag

SEQ ID NO: 3623 - RNA, 21 nt, artificial
  Chemically synthesized
agucaaaaucacuuagcaggc

SEQ ID NO: 3624 - RNA, 21 nt, artificial
  Chemically synthesized
guuagaacacuggcuaauuug

SEQ ID NO: 3625 - RNA, 21 nt, artificial
  Chemically synthesized
uaacaggcaagagagucaaag

SEQ ID NO: 3626 - RNA, 21 nt, artificial
  Chemically synthesized
ucaguaacaggaucacaccug

SEQ ID NO: 3627 - RNA, 21 nt, artificial
  Chemically synthesized
uuccaaucagugaguaaaguu

SEQ ID NO: 3628 - RNA, 21 nt, artificial
  Chemically synthesized
ucaguuucucagggacaagga

SEQ ID NO: 3629 - RNA, 21 nt, artificial
  Chemically synthesized
uccauaagccaucaccauuuu

SEQ ID NO: 3630 - RNA, 21 nt, artificial
  Chemically synthesized
uguuagaacacuggcuaauuu

SEQ ID NO: 3631 - RNA, 21 nt, artificial
  Chemically synthesized
cuuaccuauuccaucccauuc

SEQ ID NO: 3632 - RNA, 21 nt, artificial
  Chemically synthesized
auuuaacagccuuccauaagc

SEQ ID NO: 3633 - RNA, 21 nt, artificial
  Chemically synthesized
uaguauacagcuacuacccuu

SEQ ID NO: 3634 - RNA, 21 nt, artificial
  Chemically synthesized
uuaucuggacggugaguuuca

SEQ ID NO: 3635 - RNA, 21 nt, artificial
  Chemically synthesized
agaaaaagucccugaagcuag

SEQ ID NO: 3636 - RNA, 21 nt, artificial
  Chemically synthesized
uguuguuccaaucagugagua

SEQ ID NO: 3637 - RNA, 21 nt, artificial
  Chemically synthesized
ucccaguagucaaaaucacuu

SEQ ID NO: 3638 - RNA, 21 nt, artificial
  Chemically synthesized
ugaagcaguuccauuauugcc

SEQ ID NO: 3639 - RNA, 21 nt, artificial
  Chemically synthesized
agcugaauaguuuuacuaccc

SEQ ID NO: 3640 - RNA, 21 nt, artificial
  Chemically synthesized
acaaaaaugggaucuaugcag

SEQ ID NO: 3641 - RNA, 21 nt, artificial
  Chemically synthesized
cuuuuguugccucuuuaaaac

SEQ ID NO: 3642 - RNA, 21 nt, artificial
  Chemically synthesized
uaccucguugagguuggguuc

SEQ ID NO: 3643 - RNA, 21 nt, artificial
  Chemically synthesized
ugugaaguggagcuaauagcu

SEQ ID NO: 3644 - RNA, 21 nt, artificial
  Chemically synthesized
augaaugugaaacacagaaag

SEQ ID NO: 3645 - RNA, 21 nt, artificial
  Chemically synthesized
agccacaguccagcaauucug

SEQ ID NO: 3646 - RNA, 21 nt, artificial
  Chemically synthesized
ugagcaaccaaguuuaguuug

SEQ ID NO: 3647 - RNA, 21 nt, artificial
  Chemically synthesized
ucuacaucgaugcccaagaag

SEQ ID NO: 3648 - RNA, 21 nt, artificial
  Chemically synthesized
uauacagcuacuacccuugac

SEQ ID NO: 3649 - RNA, 21 nt, artificial
  Chemically synthesized
uagcuagggcaggaaaccuga

SEQ ID NO: 3650 - RNA, 21 nt, artificial
  Chemically synthesized
aaggacaacaguucuacaucg

SEQ ID NO: 3651 - RNA, 21 nt, artificial
  Chemically synthesized
acaguucuacaucgaugccca

SEQ ID NO: 3652 - RNA, 21 nt, artificial
  Chemically synthesized
ugguaguauacagcuacuacc

SEQ ID NO: 3653 - RNA, 21 nt, artificial
  Chemically synthesized
ugaaacacagaaagaaaagag

SEQ ID NO: 3654 - RNA, 21 nt, artificial
  Chemically synthesized
uuuggacagacaguucuccag

SEQ ID NO: 3655 - RNA, 21 nt, artificial
  Chemically synthesized
uugcccagucaguggugacaa

SEQ ID NO: 3656 - RNA, 21 nt, artificial
  Chemically synthesized
guuuaguuugcuuugauuugg

SEQ ID NO: 3657 - RNA, 21 nt, artificial
  Chemically synthesized
cuuuguaguaucuuuccaagc

SEQ ID NO: 3658 - RNA, 21 nt, artificial
  Chemically synthesized
cagagaugagauaacacugcc

SEQ ID NO: 3659 - RNA, 21 nt, artificial
  Chemically synthesized
uuccaucccauucaauucugu

SEQ ID NO: 3660 - RNA, 21 nt, artificial
  Chemically synthesized
ucacuguuguuccaaucagug

SEQ ID NO: 3661 - RNA, 21 nt, artificial
  Chemically synthesized
uacucuuaccuaggguuaagc

SEQ ID NO: 3662 - RNA, 21 nt, artificial
  Chemically synthesized
uuguaagcauaacaggcaaga

SEQ ID NO: 3663 - RNA, 21 nt, artificial
  Chemically synthesized
agucaaagauaacuguuagug

SEQ ID NO: 3664 - RNA, 21 nt, artificial
  Chemically synthesized
aaaaucacuuagcaggcucuc

SEQ ID NO: 3665 - RNA, 21 nt, artificial
  Chemically synthesized
ugagucaggaacugguggugu

SEQ ID NO: 3666 - RNA, 21 nt, artificial
  Chemically synthesized
cuacccaaucaugaaauaauc

SEQ ID NO: 3667 - RNA, 21 nt, artificial
  Chemically synthesized
uuguaguaucuuuccaagcau

SEQ ID NO: 3668 - RNA, 21 nt, artificial
  Chemically synthesized
uacaaaaaugggaucuaugca

SEQ ID NO: 3669 - RNA, 21 nt, artificial
  Chemically synthesized
uauagucuauuaccaagccua

SEQ ID NO: 3670 - RNA, 21 nt, artificial
  Chemically synthesized
uaaucccaguagucaaaauca

SEQ ID NO: 3671 - RNA, 21 nt, artificial
  Chemically synthesized
ucuaggcuguacuauaaacca

SEQ ID NO: 3672 - RNA, 21 nt, artificial
  Chemically synthesized
auaucuccauagccaaugcag

SEQ ID NO: 3673 - RNA, 21 nt, artificial
  Chemically synthesized
uaucuuggcccaauucuauaa

SEQ ID NO: 3674 - RNA, 21 nt, artificial
  Chemically synthesized
aaagauuggcuuuguaguauc

SEQ ID NO: 3675 - RNA, 21 nt, artificial
  Chemically synthesized
aaggauaugaaagccuugcug

SEQ ID NO: 3676 - RNA, 21 nt, artificial
  Chemically synthesized
auagccacaguccagcaauuc

SEQ ID NO: 3677 - RNA, 21 nt, artificial
  Chemically synthesized
ucuuaacaagucgaaauccug

SEQ ID NO: 3678 - RNA, 21 nt, artificial
  Chemically synthesized
aguuucucagggacaaggacc

SEQ ID NO: 3679 - RNA, 21 nt, artificial
  Chemically synthesized
accuguuuuucaguaacacca

SEQ ID NO: 3680 - RNA, 21 nt, artificial
  Chemically synthesized
cacagguauucaucauucacu

SEQ ID NO: 3681 - RNA, 21 nt, artificial
  Chemically synthesized
caagagagucaaagauaacug

SEQ ID NO: 3682 - RNA, 21 nt, artificial
  Chemically synthesized
aagcaguuccauuauugccgu

SEQ ID NO: 3683 - RNA, 21 nt, artificial
  Chemically synthesized
uggcaaguugauuccucaaau

SEQ ID NO: 3684 - RNA, 21 nt, artificial
  Chemically synthesized
auauuaccucguugagguugg

SEQ ID NO: 3685 - RNA, 21 nt, artificial
  Chemically synthesized
auucaacacuuaagaacaggg

SEQ ID NO: 3686 - RNA, 21 nt, artificial
  Chemically synthesized
acugccauggugaaaugguuc

SEQ ID NO: 3687 - RNA, 21 nt, artificial
  Chemically synthesized
ugaguuucauucucuaggcug

SEQ ID NO: 3688 - RNA, 21 nt, artificial
  Chemically synthesized
uuuuggaaguuuugauaggcu

SEQ ID NO: 3689 - RNA, 21 nt, artificial
  Chemically synthesized
ugcauaacacaaccucgcaag

SEQ ID NO: 3690 - RNA, 21 nt, artificial
  Chemically synthesized
uaaaacucaaaugggcuucua

SEQ ID NO: 3691 - RNA, 21 nt, artificial
  Chemically synthesized
uauuauucccuagugacaggu

SEQ ID NO: 3692 - RNA, 21 nt, artificial
  Chemically synthesized
uacaaaugacuuuagcugacu

SEQ ID NO: 3693 - RNA, 21 nt, artificial
  Chemically synthesized
gauuaagcacauguaauacug

SEQ ID NO: 3694 - RNA, 21 nt, artificial
  Chemically synthesized
aagguggaaaaaaucugggug

SEQ ID NO: 3695 - RNA, 21 nt, artificial
  Chemically synthesized
aagccaucaccauuuuguaag

SEQ ID NO: 3696 - RNA, 21 nt, artificial
  Chemically synthesized
uucuccagcauuuuaaccaaa

SEQ ID NO: 3697 - RNA, 21 nt, artificial
  Chemically synthesized
ucacucaauggaagaguaauc

SEQ ID NO: 3698 - RNA, 21 nt, artificial
  Chemically synthesized
uggagcuuaacaauagacaug

SEQ ID NO: 3699 - RNA, 21 nt, artificial
  Chemically synthesized
ugaauacaucugucccuacgc

SEQ ID NO: 3700 - RNA, 21 nt, artificial
  Chemically synthesized
uugcaaccauggucaacggcu

SEQ ID NO: 3701 - RNA, 21 nt, artificial
  Chemically synthesized
ucugagauuaagcacauguaa

SEQ ID NO: 3702 - RNA, 21 nt, artificial
  Chemically synthesized
uucccagaaaagcccagagau

SEQ ID NO: 3703 - RNA, 21 nt, artificial
  Chemically synthesized
gucaguuucucagggacaagg

SEQ ID NO: 3704 - RNA, 21 nt, artificial
  Chemically synthesized
auuuaucuuggcccaauucua

SEQ ID NO: 3705 - RNA, 21 nt, artificial
  Chemically synthesized
ucuacuaaagaaaaagucccu

SEQ ID NO: 3706 - RNA, 21 nt, artificial
  Chemically synthesized
agguauucaucauucacucaa

SEQ ID NO: 3707 - RNA, 21 nt, artificial
  Chemically synthesized
acaacaguucuacaucgaugc

SEQ ID NO: 3708 - RNA, 21 nt, artificial
  Chemically synthesized
ucguaaauugacccguuucaa

SEQ ID NO: 3709 - RNA, 21 nt, artificial
  Chemically synthesized
cuccauagccaaugcagacuu

SEQ ID NO: 3710 - RNA, 21 nt, artificial
  Chemically synthesized
uuggagcuuaacaauagacau

SEQ ID NO: 3711 - RNA, 21 nt, artificial
  Chemically synthesized
auugauuuaucuuggcccaau

SEQ ID NO: 3712 - RNA, 21 nt, artificial
  Chemically synthesized
ugguucaucugagauuaagca

SEQ ID NO: 3713 - RNA, 21 nt, artificial
  Chemically synthesized
aacuacaaaugacuuuagcug

SEQ ID NO: 3714 - RNA, 21 nt, artificial
  Chemically synthesized
aggacaucuugagcaauucuc

SEQ ID NO: 3715 - RNA, 21 nt, artificial
  Chemically synthesized
auaaaccauaucuccauagcc

SEQ ID NO: 3716 - RNA, 21 nt, artificial
  Chemically synthesized
aguggagcuaauagcuagggc

SEQ ID NO: 3717 - RNA, 21 nt, artificial
  Chemically synthesized
uccagcaauucugaaaugcug

SEQ ID NO: 3718 - RNA, 21 nt, artificial
  Chemically synthesized
aaguguaagcucaaaaguagg

SEQ ID NO: 3719 - RNA, 21 nt, artificial
  Chemically synthesized
acaucuugagcaauucucugg

SEQ ID NO: 3720 - RNA, 21 nt, artificial
  Chemically synthesized
agucuauuaccaagccuaccu

SEQ ID NO: 3721 - RNA, 21 nt, artificial
  Chemically synthesized
auaaucccaguagucaaaauc

SEQ ID NO: 3722 - RNA, 21 nt, artificial
  Chemically synthesized
auccucacagguauucaucau

SEQ ID NO: 3723 - RNA, 21 nt, artificial
  Chemically synthesized
aacacagugaaccuuuggagc

SEQ ID NO: 3724 - RNA, 21 nt, artificial
  Chemically synthesized
auaguaucaguaacaggauca

SEQ ID NO: 3725 - RNA, 21 nt, artificial
  Chemically synthesized
augcagacuucguaaauugac

SEQ ID NO: 3726 - RNA, 21 nt, artificial
  Chemically synthesized
auggucaacggcucuguuucc

SEQ ID NO: 3727 - RNA, 21 nt, artificial
  Chemically synthesized
acaggaucacaccuguuuuuc

SEQ ID NO: 3728 - RNA, 21 nt, artificial
  Chemically synthesized
uacuaaagaaaaagucccuga

SEQ ID NO: 3729 - RNA, 21 nt, artificial
  Chemically synthesized
aguuuuacuacccaaucauga

SEQ ID NO: 3730 - RNA, 21 nt, artificial
  Chemically synthesized
agucccugaagcuaguccaug

SEQ ID NO: 3731 - RNA, 21 nt, artificial
  Chemically synthesized
acgugcauaacacaaccucgc

SEQ ID NO: 3732 - RNA, 21 nt, artificial
  Chemically synthesized
uuaccucguugagguuggguu

SEQ ID NO: 3733 - RNA, 21 nt, artificial
  Chemically synthesized
cuguacuauaaaccauaucuc

SEQ ID NO: 3734 - RNA, 21 nt, artificial
  Chemically synthesized
aucaguaacaggaucacaccu

SEQ ID NO: 3735 - RNA, 21 nt, artificial
  Chemically synthesized
aauucucugggucaguuucuc

SEQ ID NO: 3736 - RNA, 21 nt, artificial
  Chemically synthesized
ugggaucuaugcagaaaaucu

SEQ ID NO: 3737 - RNA, 21 nt, artificial
  Chemically synthesized
aauucuggcaaguugauuccu

SEQ ID NO: 3738 - RNA, 21 nt, artificial
  Chemically synthesized
aaaaucugggugcaugcaugg

SEQ ID NO: 3739 - RNA, 21 nt, artificial
  Chemically synthesized
uaguggaaaaaggacaacagu

SEQ ID NO: 3740 - RNA, 21 nt, artificial
  Chemically synthesized
auuuacucuuaccuaggguua

SEQ ID NO: 3741 - RNA, 21 nt, artificial
  Chemically synthesized
uucaguaacaccaggaugaau

SEQ ID NO: 3742 - RNA, 21 nt, artificial
  Chemically synthesized
auaaggccuuuauuauucccu

SEQ ID NO: 3743 - RNA, 21 nt, artificial
  Chemically synthesized
ugaaccuuuggagcuuaacaa

SEQ ID NO: 3744 - RNA, 21 nt, artificial
  Chemically synthesized
ucagaguucuccugaaaccag

SEQ ID NO: 3745 - RNA, 21 nt, artificial
  Chemically synthesized
uggcuuuguaguaucuuucca

SEQ ID NO: 3746 - RNA, 21 nt, artificial
  Chemically synthesized
auccugagcugaggaucagag

SEQ ID NO: 3747 - RNA, 21 nt, artificial
  Chemically synthesized
ugcugcucaaacugccaguug

SEQ ID NO: 3748 - RNA, 21 nt, artificial
  Chemically synthesized
augggcuucuacuuuugcuua

SEQ ID NO: 3749 - RNA, 21 nt, artificial
  Chemically synthesized
augggaucuaugcagaaaauc

SEQ ID NO: 3750 - RNA, 21 nt, artificial
  Chemically synthesized
guggaaucaaauguaaaacuc

SEQ ID NO: 3751 - RNA, 21 nt, artificial
  Chemically synthesized
uggagcuaauagcuagggcag

SEQ ID NO: 3752 - RNA, 21 nt, artificial
  Chemically synthesized
ucaaagauaacuguuagugga

SEQ ID NO: 3753 - RNA, 21 nt, artificial
  Chemically synthesized
auauagucuauuaccaagccu

SEQ ID NO: 3754 - RNA, 21 nt, artificial
  Chemically synthesized
ugaaauggcaccacaagcuuu

SEQ ID NO: 3755 - RNA, 21 nt, artificial
  Chemically synthesized
uuuggaaguuuugauaggcua

SEQ ID NO: 3756 - RNA, 21 nt, artificial
  Chemically synthesized
ucuacuuaguuggaauaagac

SEQ ID NO: 3757 - RNA, 21 nt, artificial
  Chemically synthesized
acuacaaaugacuuuagcuga

SEQ ID NO: 3758 - RNA, 21 nt, artificial
  Chemically synthesized
ucagccuguuagcugcaguug

SEQ ID NO: 3759 - RNA, 21 nt, artificial
  Chemically synthesized
agcucaaaaguagguacgacg

SEQ ID NO: 3760 - RNA, 21 nt, artificial
  Chemically synthesized
aggacccuucaaucacuguug

SEQ ID NO: 3761 - RNA, 21 nt, artificial
  Chemically synthesized
aagaaacagugaagcaguucc

SEQ ID NO: 3762 - RNA, 21 nt, artificial
  Chemically synthesized
ccaagguggaaaaaaucuggg

SEQ ID NO: 3763 - RNA, 21 nt, artificial
  Chemically synthesized
aaugguucaucugagauuaag

SEQ ID NO: 3764 - RNA, 21 nt, artificial
  Chemically synthesized
uaacaggaucacaccuguuuu

SEQ ID NO: 3765 - RNA, 21 nt, artificial
  Chemically synthesized
ucagagagggacuagaucuca

SEQ ID NO: 3766 - RNA, 21 nt, artificial
  Chemically synthesized
aaccaaguuuaguuugcuuug

SEQ ID NO: 3767 - RNA, 21 nt, artificial
  Chemically synthesized
uucuugcugcucaaacugcca

SEQ ID NO: 3768 - RNA, 21 nt, artificial
  Chemically synthesized
ugaggaagucaccaagaaaca

SEQ ID NO: 3769 - RNA, 21 nt, artificial
  Chemically synthesized
uagaacacuggcuaauuugaa

SEQ ID NO: 3770 - RNA, 21 nt, artificial
  Chemically synthesized
accaagaaacagugaagcagu

SEQ ID NO: 3771 - RNA, 21 nt, artificial
  Chemically synthesized
ucuugagcaauucucuggguc

SEQ ID NO: 3772 - RNA, 21 nt, artificial
  Chemically synthesized
uaaggagagauacuucaauuc

SEQ ID NO: 3773 - RNA, 21 nt, artificial
  Chemically synthesized
ugaaucagagagggacuagau

SEQ ID NO: 3774 - RNA, 21 nt, artificial
  Chemically synthesized
aguaucuuuccaagcauuuga

SEQ ID NO: 3775 - RNA, 21 nt, artificial
  Chemically synthesized
agcuacuacccuugacaauug

SEQ ID NO: 3776 - RNA, 21 nt, artificial
  Chemically synthesized
aacccuucaaauuugagucag

SEQ ID NO: 3777 - RNA, 21 nt, artificial
  Chemically synthesized
uaagccaucaccauuuuguaa

SEQ ID NO: 3778 - RNA, 21 nt, artificial
  Chemically synthesized
auucccagaaaagcccagaga

SEQ ID NO: 3779 - RNA, 21 nt, artificial
  Chemically synthesized
aacugguggugugggcuuuug

SEQ ID NO: 3780 - RNA, 21 nt, artificial
  Chemically synthesized
cuagaaucacacacaauccua

SEQ ID NO: 3781 - RNA, 21 nt, artificial
  Chemically synthesized
uaguaucuuuccaagcauuug

SEQ ID NO: 3782 - RNA, 21 nt, artificial
  Chemically synthesized
acuuauaguaucaguaacagg

SEQ ID NO: 3783 - RNA, 21 nt, artificial
  Chemically synthesized
agguggaaaaaaucugggugc

SEQ ID NO: 3784 - RNA, 21 nt, artificial
  Chemically synthesized
ugccucuuuaaaacauuagag

SEQ ID NO: 3785 - RNA, 21 nt, artificial
  Chemically synthesized
ucaaauuugagucaggaacug

SEQ ID NO: 3786 - RNA, 21 nt, artificial
  Chemically synthesized
aaacacagaaagaaaagagac

SEQ ID NO: 3787 - RNA, 21 nt, artificial
  Chemically synthesized
cuaugcagaaaaucuacacua

SEQ ID NO: 3788 - RNA, 21 nt, artificial
  Chemically synthesized
acucaccuacuuaauccuacc

SEQ ID NO: 3789 - RNA, 21 nt, artificial
  Chemically synthesized
uagguacgacgcuagaaucac

SEQ ID NO: 3790 - RNA, 21 nt, artificial
  Chemically synthesized
caguucuccagcauuuuaacc

SEQ ID NO: 3791 - RNA, 21 nt, artificial
  Chemically synthesized
uggugaaaugguucaucugag

SEQ ID NO: 3792 - RNA, 21 nt, artificial
  Chemically synthesized
auucucugggucaguuucuca

SEQ ID NO: 3793 - RNA, 21 nt, artificial
  Chemically synthesized
aggaccuuugagcaaccaagu

SEQ ID NO: 3794 - RNA, 21 nt, artificial
  Chemically synthesized
aaacucaccuacuuaauccua

SEQ ID NO: 3795 - RNA, 21 nt, artificial
  Chemically synthesized
uaaacucaccuacuuaauccu

SEQ ID NO: 3796 - RNA, 21 nt, artificial
  Chemically synthesized
uaacuguuaguggaaaaagga

SEQ ID NO: 3797 - RNA, 21 nt, artificial
  Chemically synthesized
uaaacacaggcagguggcuuc

SEQ ID NO: 3798 - RNA, 21 nt, artificial
  Chemically synthesized
cuacaucgaugcccaagaagc

SEQ ID NO: 3799 - RNA, 21 nt, artificial
  Chemically synthesized
ugcuuugauuuggacagacag

SEQ ID NO: 3800 - RNA, 21 nt, artificial
  Chemically synthesized
aucacacacaauccuauccag

SEQ ID NO: 3801 - RNA, 21 nt, artificial
  Chemically synthesized
ucaauucccagaaaagcccag

SEQ ID NO: 3802 - RNA, 21 nt, artificial
  Chemically synthesized
agagucaaagauaacuguuag

SEQ ID NO: 3803 - RNA, 21 nt, artificial
  Chemically synthesized
auccuauccagcuuuuuacau

SEQ ID NO: 3804 - RNA, 21 nt, artificial
  Chemically synthesized
uucuccugaaaccagaggaga

SEQ ID NO: 3805 - RNA, 21 nt, artificial
  Chemically synthesized
guauccaagguggaaaaaauc

SEQ ID NO: 3806 - RNA, 21 nt, artificial
  Chemically synthesized
ugguuaucuggacggugaguu

SEQ ID NO: 3807 - RNA, 21 nt, artificial
  Chemically synthesized
aucccaguagucaaaaucacu

SEQ ID NO: 3808 - RNA, 21 nt, artificial
  Chemically synthesized
acuuuugcuuaccuauuccau

SEQ ID NO: 3809 - RNA, 21 nt, artificial
  Chemically synthesized
cuuuugcuuaccuauuccauc

SEQ ID NO: 3810 - RNA, 21 nt, artificial
  Chemically synthesized
cucuaggcuguacuauaaacc

SEQ ID NO: 3811 - RNA, 21 nt, artificial
  Chemically synthesized
acgcuagaaucacacacaauc

SEQ ID NO: 3812 - RNA, 21 nt, artificial
  Chemically synthesized
gaagcaguuccauuauugccg

SEQ ID NO: 3813 - RNA, 21 nt, artificial
  Chemically synthesized
aaacacagugaaccuuuggag

SEQ ID NO: 3814 - RNA, 21 nt, artificial
  Chemically synthesized
aaacacaggcagguggcuucu

SEQ ID NO: 3815 - RNA, 21 nt, artificial
  Chemically synthesized
auacagcuacuacccuugaca

SEQ ID NO: 3816 - RNA, 21 nt, artificial
  Chemically synthesized
guauucaucauucacucaaug

SEQ ID NO: 3817 - RNA, 21 nt, artificial
  Chemically synthesized
aauagcuagggcaggaaaccu

SEQ ID NO: 3818 - RNA, 21 nt, artificial
  Chemically synthesized
ucguugagguuggguucagga

SEQ ID NO: 3819 - RNA, 21 nt, artificial
  Chemically synthesized
aaacucaaaugggcuucuacu

SEQ ID NO: 3820 - RNA, 21 nt, artificial
  Chemically synthesized
ugaacauuguugaguggaggc

SEQ ID NO: 3821 - RNA, 21 nt, artificial
  Chemically synthesized
acaguucuccagcauuuuaac

SEQ ID NO: 3822 - RNA, 21 nt, artificial
  Chemically synthesized
auuuccuauccucacagguau

SEQ ID NO: 3823 - RNA, 21 nt, artificial
  Chemically synthesized
caucccauucaauucuguaca

SEQ ID NO: 3824 - RNA, 21 nt, artificial
  Chemically synthesized
cccagagaugagauaacacug

SEQ ID NO: 3825 - RNA, 21 nt, artificial
  Chemically synthesized
aaagucccugaagcuagucca

SEQ ID NO: 3826 - RNA, 21 nt, artificial
  Chemically synthesized
aacuaauuuccuauccucaca

SEQ ID NO: 3827 - RNA, 21 nt, artificial
  Chemically synthesized
accacaagcuuuuguugccuc

SEQ ID NO: 3828 - RNA, 21 nt, artificial
  Chemically synthesized
aucacuucuccaaaggccaga

SEQ ID NO: 3829 - RNA, 21 nt, artificial
  Chemically synthesized
ucccagaaaagcccagagaug

SEQ ID NO: 3830 - RNA, 21 nt, artificial
  Chemically synthesized
uggacggugaguuucauucuc

SEQ ID NO: 3831 - RNA, 21 nt, artificial
  Chemically synthesized
uucucuaggcuguacuauaaa

SEQ ID NO: 3832 - RNA, 21 nt, artificial
  Chemically synthesized
uggaaaaaggacaacaguucu

SEQ ID NO: 3833 - RNA, 21 nt, artificial
  Chemically synthesized
uuugagcaaccaaguuuaguu

SEQ ID NO: 3834 - RNA, 21 nt, artificial
  Chemically synthesized
acauuagagugaggaagucac

SEQ ID NO: 3835 - RNA, 21 nt, artificial
  Chemically synthesized
aauggcaccacaagcuuuugu

SEQ ID NO: 3836 - RNA, 21 nt, artificial
  Chemically synthesized
uugagcaauucucugggucag

SEQ ID NO: 3837 - RNA, 21 nt, artificial
  Chemically synthesized
cuuaacaagucgaaauccuga

SEQ ID NO: 3838 - RNA, 21 nt, artificial
  Chemically synthesized
ucauucacucaauggaagagu

SEQ ID NO: 3839 - RNA, 21 nt, artificial
  Chemically synthesized
caaacuacaaaugacuuuagc

SEQ ID NO: 3840 - RNA, 21 nt, artificial
  Chemically synthesized
accauaucuccauagccaaug

SEQ ID NO: 3841 - RNA, 21 nt, artificial
  Chemically synthesized
aagcuaguccaugagcaguuc

SEQ ID NO: 3842 - RNA, 21 nt, artificial
  Chemically synthesized
aaggaccuuugagcaaccaag

SEQ ID NO: 3843 - RNA, 21 nt, artificial
  Chemically synthesized
uauucccuagugacagguauc

SEQ ID NO: 3844 - RNA, 21 nt, artificial
  Chemically synthesized
uuucucagggacaaggaccuu

SEQ ID NO: 3845 - RNA, 21 nt, artificial
  Chemically synthesized
guucuugcugcucaaacugcc

SEQ ID NO: 3846 - RNA, 21 nt, artificial
  Chemically synthesized
aaucacuucuccaaaggccag

SEQ ID NO: 3847 - RNA, 21 nt, artificial
  Chemically synthesized
uucaaucacuguuguuccaau

SEQ ID NO: 3848 - RNA, 21 nt, artificial
  Chemically synthesized
uaacaccaggaugaauacauc

SEQ ID NO: 3849 - RNA, 21 nt, artificial
  Chemically synthesized
aguugcaaccauggucaacgg

SEQ ID NO: 3850 - RNA, 21 nt, artificial
  Chemically synthesized
aggcaaaucugguuuauauag

SEQ ID NO: 3851 - RNA, 21 nt, artificial
  Chemically synthesized
aaaggacaacaguucuacauc

SEQ ID NO: 3852 - RNA, 23 nt, artificial
  Chemically synthesized
gaguuuuacauuugauuccacaa

SEQ ID NO: 3853 - RNA, 23 nt, artificial
  Chemically synthesized
gguaauagacuauauaaaccaga

SEQ ID NO: 3854 - RNA, 23 nt, artificial
  Chemically synthesized
gggaauugaaguaucucuccuua

SEQ ID NO: 3855 - RNA, 23 nt, artificial
  Chemically synthesized
gaaaauguauguaaaaagcugga

SEQ ID NO: 3856 - RNA, 23 nt, artificial
  Chemically synthesized
cagaggauuuuuuaaaucacaga

SEQ ID NO: 3857 - RNA, 23 nt, artificial
  Chemically synthesized
ggcuguuaaauuaauauuccugu

SEQ ID NO: 3858 - RNA, 23 nt, artificial
  Chemically synthesized
gccuuauuuuuugucuuauucca

SEQ ID NO: 3859 - RNA, 23 nt, artificial
  Chemically synthesized
caaauuugaaggguuuuuagaca

SEQ ID NO: 3860 - RNA, 23 nt, artificial
  Chemically synthesized
cuaagugauuuugacuacuggga

SEQ ID NO: 3861 - RNA, 23 nt, artificial
  Chemically synthesized
cuaucacccagagagccugcuaa

SEQ ID NO: 3862 - RNA, 23 nt, artificial
  Chemically synthesized
agauguccugcggcuuuccucaa

SEQ ID NO: 3863 - RNA, 23 nt, artificial
  Chemically synthesized
aacuauucagcuagucagcuaaa

SEQ ID NO: 3864 - RNA, 23 nt, artificial
  Chemically synthesized
guuguuuugcaugucuauuguua

SEQ ID NO: 3865 - RNA, 23 nt, artificial
  Chemically synthesized
ugaguuuuacauuugauuccaca

SEQ ID NO: 3866 - RNA, 23 nt, artificial
  Chemically synthesized
gguaguaaaacuauucagcuagu

SEQ ID NO: 3867 - RNA, 23 nt, artificial
  Chemically synthesized
aguauuacaugugcuuaaucuca

SEQ ID NO: 3868 - RNA, 23 nt, artificial
  Chemically synthesized
cuguuaugcuuacaaaaugguga

SEQ ID NO: 3869 - RNA, 23 nt, artificial
  Chemically synthesized
ucucuugccuguuaugcuuacaa

SEQ ID NO: 3870 - RNA, 23 nt, artificial
  Chemically synthesized
ccauuucaccauggcaguguuau

SEQ ID NO: 3871 - RNA, 23 nt, artificial
  Chemically synthesized
ugauccucagcucaggauuucga

SEQ ID NO: 3872 - RNA, 23 nt, artificial
  Chemically synthesized
caaaauaguguagauuuucugca

SEQ ID NO: 3873 - RNA, 23 nt, artificial
  Chemically synthesized
gguuaaaaugcuggagaacuguc

SEQ ID NO: 3874 - RNA, 23 nt, artificial
  Chemically synthesized
cugauauuuuuguguguaguuga

SEQ ID NO: 3875 - RNA, 23 nt, artificial
  Chemically synthesized
guaggugaguuuaauuaaagcuu

SEQ ID NO: 3876 - RNA, 23 nt, artificial
  Chemically synthesized
acaaacuaaacucuucaaaugcu

SEQ ID NO: 3877 - RNA, 23 nt, artificial
  Chemically synthesized
ccuacuuuugagcuuacacuugu

SEQ ID NO: 3878 - RNA, 23 nt, artificial
  Chemically synthesized
gcccauuugaguuuuacauuuga

SEQ ID NO: 3879 - RNA, 23 nt, artificial
  Chemically synthesized
gauuacucuuccauugagugaau

SEQ ID NO: 3880 - RNA, 23 nt, artificial
  Chemically synthesized
uguuaugcuuacaaaauggugau

SEQ ID NO: 3881 - RNA, 23 nt, artificial
  Chemically synthesized
aguugucaccacugacugggcaa

SEQ ID NO: 3882 - RNA, 23 nt, artificial
  Chemically synthesized
cucaaauuugaaggguuuuuaga

SEQ ID NO: 3883 - RNA, 23 nt, artificial
  Chemically synthesized
gcuucuccucugguuucaggaga

SEQ ID NO: 3884 - RNA, 23 nt, artificial
  Chemically synthesized
gcaacugcagcuaacaggcugau

SEQ ID NO: 3885 - RNA, 23 nt, artificial
  Chemically synthesized
gacagauguauucauccuggugu

SEQ ID NO: 3886 - RNA, 23 nt, artificial
  Chemically synthesized
gaacugcucauggacuagcuuca

SEQ ID NO: 3887 - RNA, 23 nt, artificial
  Chemically synthesized
uauuuagccuaucaaaacuucca

SEQ ID NO: 3888 - RNA, 23 nt, artificial
  Chemically synthesized
cccauuugaguuuuacauuugau

SEQ ID NO: 3889 - RNA, 23 nt, artificial
  Chemically synthesized
cuaagaagccaccugccuguguu

SEQ ID NO: 3890 - RNA, 23 nt, artificial
  Chemically synthesized
cuaucaaaacuuccaaaagccca

SEQ ID NO: 3891 - RNA, 23 nt, artificial
  Chemically synthesized
ugauuacucuuccauugagugaa

SEQ ID NO: 3892 - RNA, 23 nt, artificial
  Chemically synthesized
uaauuaaagcuuaacccuaggua

SEQ ID NO: 3893 - RNA, 23 nt, artificial
  Chemically synthesized
cccuagcuauuagcuccacuuca

SEQ ID NO: 3894 - RNA, 23 nt, artificial
  Chemically synthesized
gggacagauguauucauccuggu

SEQ ID NO: 3895 - RNA, 23 nt, artificial
  Chemically synthesized
ugaacccaaccucaacgagguaa

SEQ ID NO: 3896 - RNA, 23 nt, artificial
  Chemically synthesized
agguaagcaaaaguagaagccca

SEQ ID NO: 3897 - RNA, 23 nt, artificial
  Chemically synthesized
acaauuugguuucagguaggcuu

SEQ ID NO: 3898 - RNA, 23 nt, artificial
  Chemically synthesized
gacucucuugccuguuaugcuua

SEQ ID NO: 3899 - RNA, 23 nt, artificial
  Chemically synthesized
gucucuuuucuuucuguguuuca

SEQ ID NO: 3900 - RNA, 23 nt, artificial
  Chemically synthesized
cucugauccucagcucaggauuu

SEQ ID NO: 3901 - RNA, 23 nt, artificial
  Chemically synthesized
guuuaagcaggagaacugcucau

SEQ ID NO: 3902 - RNA, 23 nt, artificial
  Chemically synthesized
gguaagcaaaaguagaagcccau

SEQ ID NO: 3903 - RNA, 23 nt, artificial
  Chemically synthesized
gaacucugauccucagcucagga

SEQ ID NO: 3904 - RNA, 23 nt, artificial
  Chemically synthesized
ucuguguuucacauucauagcaa

SEQ ID NO: 3905 - RNA, 23 nt, artificial
  Chemically synthesized
uguuuugcaugucuauuguuaag

SEQ ID NO: 3906 - RNA, 23 nt, artificial
  Chemically synthesized
ugaaaaacaggugugauccuguu

SEQ ID NO: 3907 - RNA, 23 nt, artificial
  Chemically synthesized
ccuauuuugauuuucauauggcu

SEQ ID NO: 3908 - RNA, 23 nt, artificial
  Chemically synthesized
cacuguucaaauuagccaguguu

SEQ ID NO: 3909 - RNA, 23 nt, artificial
  Chemically synthesized
caaauguagucucuuuucuuucu

SEQ ID NO: 3910 - RNA, 23 nt, artificial
  Chemically synthesized
cagauaaccaugcaugcacccag

SEQ ID NO: 3911 - RNA, 23 nt, artificial
  Chemically synthesized
guugaauacugucuuuaaacuag

SEQ ID NO: 3912 - RNA, 23 nt, artificial
  Chemically synthesized
gcaacaaaagcuuguggugccau

SEQ ID NO: 3913 - RNA, 23 nt, artificial
  Chemically synthesized
gauaugguuuauaguacagccua

SEQ ID NO: 3914 - RNA, 23 nt, artificial
  Chemically synthesized
gacuauauaaaccagauuugccu

SEQ ID NO: 3915 - RNA, 23 nt, artificial
  Chemically synthesized
cuuauuccaacuaaguagaucau

SEQ ID NO: 3916 - RNA, 23 nt, artificial
  Chemically synthesized
guauuacaugugcuuaaucucag

SEQ ID NO: 3917 - RNA, 23 nt, artificial
  Chemically synthesized
aguaaaacuauucagcuagucag

SEQ ID NO: 3918 - RNA, 23 nt, artificial
  Chemically synthesized
cucucuugccuguuaugcuuaca

SEQ ID NO: 3919 - RNA, 23 nt, artificial
  Chemically synthesized
agauuauuucaugauuggguagu

SEQ ID NO: 3920 - RNA, 23 nt, artificial
  Chemically synthesized
guuaaaaugcuggagaacugucu

SEQ ID NO: 3921 - RNA, 23 nt, artificial
  Chemically synthesized
aaacuauucagcuagucagcuaa

SEQ ID NO: 3922 - RNA, 23 nt, artificial
  Chemically synthesized
gaaaaacaggugugauccuguua

SEQ ID NO: 3923 - RNA, 23 nt, artificial
  Chemically synthesized
gcuucacuguuucuuggugacuu

SEQ ID NO: 3924 - RNA, 23 nt, artificial
  Chemically synthesized
agaacccggccagcauuucagaa

SEQ ID NO: 3925 - RNA, 23 nt, artificial
  Chemically synthesized
uagccuccacucaacaauguuca

SEQ ID NO: 3926 - RNA, 23 nt, artificial
  Chemically synthesized
ugaacugauauuuuuguguguag

SEQ ID NO: 3927 - RNA, 23 nt, artificial
  Chemically synthesized
aguaaucuauccucuuuucagua

SEQ ID NO: 3928 - RNA, 23 nt, artificial
  Chemically synthesized
ggugaguuuaauuaaagcuuaac

SEQ ID NO: 3929 - RNA, 23 nt, artificial
  Chemically synthesized
uguucaauucagcaaggcuuuca

SEQ ID NO: 3930 - RNA, 23 nt, artificial
  Chemically synthesized
guaaucuauccucuuuucaguau

SEQ ID NO: 3931 - RNA, 23 nt, artificial
  Chemically synthesized
ucuuucuguguuucacauucaua

SEQ ID NO: 3932 - RNA, 23 nt, artificial
  Chemically synthesized
aguaggugaguuuaauuaaagcu

SEQ ID NO: 3933 - RNA, 23 nt, artificial
  Chemically synthesized
gaaauuaguucugagaucuaguc

SEQ ID NO: 3934 - RNA, 23 nt, artificial
  Chemically synthesized
ucacuagggaauaauaaaggccu

SEQ ID NO: 3935 - RNA, 23 nt, artificial
  Chemically synthesized
aaacucaccguccagauaaccau

SEQ ID NO: 3936 - RNA, 23 nt, artificial
  Chemically synthesized
acuguuucuuggugacuuccuca

SEQ ID NO: 3937 - RNA, 23 nt, artificial
  Chemically synthesized
guguuaucucaucucugggcuuu

SEQ ID NO: 3938 - RNA, 23 nt, artificial
  Chemically synthesized
acuauaagugaccuaaaauguca

SEQ ID NO: 3939 - RNA, 23 nt, artificial
  Chemically synthesized
uuagcuccacuucacaugcugga

SEQ ID NO: 3940 - RNA, 23 nt, artificial
  Chemically synthesized
aaugucacuguucaaauuagcca

SEQ ID NO: 3941 - RNA, 23 nt, artificial
  Chemically synthesized
ugggaauugaaguaucucuccuu

SEQ ID NO: 3942 - RNA, 23 nt, artificial
  Chemically synthesized
aaaacuauucagcuagucagcua

SEQ ID NO: 3943 - RNA, 23 nt, artificial
  Chemically synthesized
ccacucaacaauguucaauucag

SEQ ID NO: 3944 - RNA, 23 nt, artificial
  Chemically synthesized
cauauggcuuuuuuuucucuaag

SEQ ID NO: 3945 - RNA, 23 nt, artificial
  Chemically synthesized
aagcuuaacccuagguaagagua

SEQ ID NO: 3946 - RNA, 23 nt, artificial
  Chemically synthesized
gaauugcuggacuguggcuauca

SEQ ID NO: 3947 - RNA, 23 nt, artificial
  Chemically synthesized
gcuaagugauuuugacuacuggg

SEQ ID NO: 3948 - RNA, 23 nt, artificial
  Chemically synthesized
aaaacaggugugauccuguuacu

SEQ ID NO: 3949 - RNA, 23 nt, artificial
  Chemically synthesized
ugcucaagauguccugcggcuuu

SEQ ID NO: 3950 - RNA, 23 nt, artificial
  Chemically synthesized
guguuacugaaaaacagguguga

SEQ ID NO: 3951 - RNA, 23 nt, artificial
  Chemically synthesized
aacucugauccucagcucaggau

SEQ ID NO: 3952 - RNA, 23 nt, artificial
  Chemically synthesized
acagauguauucauccugguguu

SEQ ID NO: 3953 - RNA, 23 nt, artificial
  Chemically synthesized
uguuuaagcaggagaacugcuca

SEQ ID NO: 3954 - RNA, 23 nt, artificial
  Chemically synthesized
acugcuucacuguuucuugguga

SEQ ID NO: 3955 - RNA, 23 nt, artificial
  Chemically synthesized
aagaagccaccugccuguguuua

SEQ ID NO: 3956 - RNA, 23 nt, artificial
  Chemically synthesized
ccacuuugaauuauugaaacggg

SEQ ID NO: 3957 - RNA, 23 nt, artificial
  Chemically synthesized
ucaagauguccugcggcuuuccu

SEQ ID NO: 3958 - RNA, 23 nt, artificial
  Chemically synthesized
gagauaugguuuauaguacagcc

SEQ ID NO: 3959 - RNA, 23 nt, artificial
  Chemically synthesized
uacacuuguguuuaagcaggaga

SEQ ID NO: 3960 - RNA, 23 nt, artificial
  Chemically synthesized
gauucacuuaguaaucuauccuc

SEQ ID NO: 3961 - RNA, 23 nt, artificial
  Chemically synthesized
ggugccauuucaguaaccacggu

SEQ ID NO: 3962 - RNA, 23 nt, artificial
  Chemically synthesized
aaucaauguuguuuugcaugucu

SEQ ID NO: 3963 - RNA, 23 nt, artificial
  Chemically synthesized
aauaauggaacugcuucacuguu

SEQ ID NO: 3964 - RNA, 23 nt, artificial
  Chemically synthesized
uauccuugcugugggucguggau

SEQ ID NO: 3965 - RNA, 23 nt, artificial
  Chemically synthesized
gauuccacaauuugguuucaggu

SEQ ID NO: 3966 - RNA, 23 nt, artificial
  Chemically synthesized
uaguaaaacuauucagcuaguca

SEQ ID NO: 3967 - RNA, 23 nt, artificial
  Chemically synthesized
acauuugauuccacaauuugguu

SEQ ID NO: 3968 - RNA, 23 nt, artificial
  Chemically synthesized
caaggcuuucauauccuugcugu

SEQ ID NO: 3969 - RNA, 23 nt, artificial
  Chemically synthesized
gaagugauucaaaauaguguaga

SEQ ID NO: 3970 - RNA, 23 nt, artificial
  Chemically synthesized
uguguuucacauucauagcaacu

SEQ ID NO: 3971 - RNA, 23 nt, artificial
  Chemically synthesized
guuucacauucauagcaacugca

SEQ ID NO: 3972 - RNA, 23 nt, artificial
  Chemically synthesized
cucaucucugggcuuuucuggga

SEQ ID NO: 3973 - RNA, 23 nt, artificial
  Chemically synthesized
ucuuauuccaacuaaguagauca

SEQ ID NO: 3974 - RNA, 23 nt, artificial
  Chemically synthesized
guuuaauuaaagcuuaacccuag

SEQ ID NO: 3975 - RNA, 23 nt, artificial
  Chemically synthesized
acauucauagcaacugcagcuaa

SEQ ID NO: 3976 - RNA, 23 nt, artificial
  Chemically synthesized
uugauuacucuuccauugaguga

SEQ ID NO: 3977 - RNA, 23 nt, artificial
  Chemically synthesized
gcuugcgagguuguguuaugcac

SEQ ID NO: 3978 - RNA, 23 nt, artificial
  Chemically synthesized
agaagccaccugccuguguuuac

SEQ ID NO: 3979 - RNA, 23 nt, artificial
  Chemically synthesized
aauguagucucuuuucuuucugu

SEQ ID NO: 3980 - RNA, 23 nt, artificial
  Chemically synthesized
uaagaagccaccugccuguguuu

SEQ ID NO: 3981 - RNA, 23 nt, artificial
  Chemically synthesized
agaacugcucauggacuagcuuc

SEQ ID NO: 3982 - RNA, 23 nt, artificial
  Chemically synthesized
cuauauaaaccagauuugccuau

SEQ ID NO: 3983 - RNA, 23 nt, artificial
  Chemically synthesized
ugguaauagacuauauaaaccag

SEQ ID NO: 3984 - RNA, 23 nt, artificial
  Chemically synthesized
gccaagauaaaucaauguuguuu

SEQ ID NO: 3985 - RNA, 23 nt, artificial
  Chemically synthesized
ucagaggauuuuuuaaaucacag

SEQ ID NO: 3986 - RNA, 23 nt, artificial
  Chemically synthesized
gauauuuagccuaucaaaacuuc

SEQ ID NO: 3987 - RNA, 23 nt, artificial
  Chemically synthesized
gagaacucugauccucagcucag

SEQ ID NO: 3988 - RNA, 23 nt, artificial
  Chemically synthesized
cacuguuucuuggugacuuccuc

SEQ ID NO: 3989 - RNA, 23 nt, artificial
  Chemically synthesized
aguaaaugagaaauauuacggca

SEQ ID NO: 3990 - RNA, 23 nt, artificial
  Chemically synthesized
acuauauaaaccagauuugccua

SEQ ID NO: 3991 - RNA, 23 nt, artificial
  Chemically synthesized
caauuugguuucagguaggcuug

SEQ ID NO: 3992 - RNA, 23 nt, artificial
  Chemically synthesized
caaagguucacuguguuucugcc

SEQ ID NO: 3993 - RNA, 23 nt, artificial
  Chemically synthesized
cauuucaccauggcaguguuauc

SEQ ID NO: 3994 - RNA, 23 nt, artificial
  Chemically synthesized
aaaaacuuuacucacugauugga

SEQ ID NO: 3995 - RNA, 23 nt, artificial
  Chemically synthesized
uguagucucuuuucuuucugugu

SEQ ID NO: 3996 - RNA, 23 nt, artificial
  Chemically synthesized
gguguuacugaaaaacaggugug

SEQ ID NO: 3997 - RNA, 23 nt, artificial
  Chemically synthesized
cuguucuuaaguguugaauacug

SEQ ID NO: 3998 - RNA, 23 nt, artificial
  Chemically synthesized
gaaaaaacuuuacucacugauug

SEQ ID NO: 3999 - RNA, 23 nt, artificial
  Chemically synthesized
gaacugauauuuuuguguguagu

SEQ ID NO: 4000 - RNA, 23 nt, artificial
  Chemically synthesized
caucgauguagaacuguuguccu

SEQ ID NO: 4001 - RNA, 23 nt, artificial
  Chemically synthesized
cuugguugcucaaagguccuugu

SEQ ID NO: 4002 - RNA, 23 nt, artificial
  Chemically synthesized
caacuaaguagaucauuaucucu

SEQ ID NO: 4003 - RNA, 23 nt, artificial
  Chemically synthesized
uaaaaugcuggagaacugucugu

SEQ ID NO: 4004 - RNA, 23 nt, artificial
  Chemically synthesized
gauaaggagcuuauucagguuuc

SEQ ID NO: 4005 - RNA, 23 nt, artificial
  Chemically synthesized
aaacagagccguugaccaugguu

SEQ ID NO: 4006 - RNA, 23 nt, artificial
  Chemically synthesized
cugcuaagugauuuugacuacug

SEQ ID NO: 4007 - RNA, 23 nt, artificial
  Chemically synthesized
ccucacucuaauguuuuaaagag

SEQ ID NO: 4008 - RNA, 23 nt, artificial
  Chemically synthesized
uuuugagcuuacacuuguguuua

SEQ ID NO: 4009 - RNA, 23 nt, artificial
  Chemically synthesized
cugaaaaacaggugugauccugu

SEQ ID NO: 4010 - RNA, 23 nt, artificial
  Chemically synthesized
ugcuuacaaaauggugauggcuu

SEQ ID NO: 4011 - RNA, 23 nt, artificial
  Chemically synthesized
gugaguuuaauuaaagcuuaacc

SEQ ID NO: 4012 - RNA, 23 nt, artificial
  Chemically synthesized
gugauggcuuauggaaggcuguu

SEQ ID NO: 4013 - RNA, 23 nt, artificial
  Chemically synthesized
cacuuugaauuauugaaacgggu

SEQ ID NO: 4014 - RNA, 23 nt, artificial
  Chemically synthesized
guucacuguguuucugccgcugu

SEQ ID NO: 4015 - RNA, 23 nt, artificial
  Chemically synthesized
aagaacccggccagcauuucaga

SEQ ID NO: 4016 - RNA, 23 nt, artificial
  Chemically synthesized
uacucuuccauugagugaaugau

SEQ ID NO: 4017 - RNA, 23 nt, artificial
  Chemically synthesized
cuugucccugagaaacugaccca

SEQ ID NO: 4018 - RNA, 23 nt, artificial
  Chemically synthesized
aagauguccugcggcuuuccuca

SEQ ID NO: 4019 - RNA, 23 nt, artificial
  Chemically synthesized
uagucucuuuucuuucuguguuu

SEQ ID NO: 4020 - RNA, 23 nt, artificial
  Chemically synthesized
guguugaauacugucuuuaaacu

SEQ ID NO: 4021 - RNA, 23 nt, artificial
  Chemically synthesized
agcaacugcagcuaacaggcuga

SEQ ID NO: 4022 - RNA, 23 nt, artificial
  Chemically synthesized
ugaaaauguauguaaaaagcugg

SEQ ID NO: 4023 - RNA, 23 nt, artificial
  Chemically synthesized
cucuuuucuuucuguguuucaca

SEQ ID NO: 4024 - RNA, 23 nt, artificial
  Chemically synthesized
ugcccuagcuauuagcuccacuu

SEQ ID NO: 4025 - RNA, 23 nt, artificial
  Chemically synthesized
agcaaacuaaacuugguugcuca

SEQ ID NO: 4026 - RNA, 23 nt, artificial
  Chemically synthesized
cuauucagcuagucagcuaaagu

SEQ ID NO: 4027 - RNA, 23 nt, artificial
  Chemically synthesized
uagaggucgcuucuccucugguu

SEQ ID NO: 4028 - RNA, 23 nt, artificial
  Chemically synthesized
aaaagcccacaccaccaguuccu

SEQ ID NO: 4029 - RNA, 23 nt, artificial
  Chemically synthesized
guccuugucccugagaaacugac

SEQ ID NO: 4030 - RNA, 23 nt, artificial
  Chemically synthesized
gaacugcuucacuguuucuuggu

SEQ ID NO: 4031 - RNA, 23 nt, artificial
  Chemically synthesized
aacagagccguugaccaugguug

SEQ ID NO: 4032 - RNA, 23 nt, artificial
  Chemically synthesized
uguguaguugauuacucuuccau

SEQ ID NO: 4033 - RNA, 23 nt, artificial
  Chemically synthesized
cugaacccaaccucaacgaggua

SEQ ID NO: 4034 - RNA, 23 nt, artificial
  Chemically synthesized
uuucugggaauugaaguaucucu

SEQ ID NO: 4035 - RNA, 23 nt, artificial
  Chemically synthesized
gcuuucauauccuugcugugggu

SEQ ID NO: 4036 - RNA, 23 nt, artificial
  Chemically synthesized
ucugauucacuuaguaaucuauc

SEQ ID NO: 4037 - RNA, 23 nt, artificial
  Chemically synthesized
cauuucaguaaccacgguguugu

SEQ ID NO: 4038 - RNA, 23 nt, artificial
  Chemically synthesized
aauguucaauucagcaaggcuuu

SEQ ID NO: 4039 - RNA, 23 nt, artificial
  Chemically synthesized
agcuccacuucacaugcuggaga

SEQ ID NO: 4040 - RNA, 23 nt, artificial
  Chemically synthesized
aaacugacccagagaauugcuca

SEQ ID NO: 4041 - RNA, 23 nt, artificial
  Chemically synthesized
cuuacacuuguguuuaagcagga

SEQ ID NO: 4042 - RNA, 23 nt, artificial
  Chemically synthesized
uaagcuccaaagguucacugugu

SEQ ID NO: 4043 - RNA, 23 nt, artificial
  Chemically synthesized
acuuuugagcuuacacuuguguu

SEQ ID NO: 4044 - RNA, 23 nt, artificial
  Chemically synthesized
uguuacugaaaaacaggugugau

SEQ ID NO: 4045 - RNA, 23 nt, artificial
  Chemically synthesized
uuuuuuccaccuuggauaccugu

SEQ ID NO: 4046 - RNA, 23 nt, artificial
  Chemically synthesized
uuacucuuccauugagugaauga

SEQ ID NO: 4047 - RNA, 23 nt, artificial
  Chemically synthesized
uuguggaaucaaauguaaaacuc

SEQ ID NO: 4048 - RNA, 23 nt, artificial
  Chemically synthesized
ucugguuuauauagucuauuacc

SEQ ID NO: 4049 - RNA, 23 nt, artificial
  Chemically synthesized
uaaggagagauacuucaauuccc

SEQ ID NO: 4050 - RNA, 23 nt, artificial
  Chemically synthesized
uccagcuuuuuacauacauuuuc

SEQ ID NO: 4051 - RNA, 23 nt, artificial
  Chemically synthesized
ucugugauuuaaaaaauccucug

SEQ ID NO: 4052 - RNA, 23 nt, artificial
  Chemically synthesized
acaggaauauuaauuuaacagcc

SEQ ID NO: 4053 - RNA, 23 nt, artificial
  Chemically synthesized
uggaauaagacaaaaaauaaggc

SEQ ID NO: 4054 - RNA, 23 nt, artificial
  Chemically synthesized
ugucuaaaaacccuucaaauuug

SEQ ID NO: 4055 - RNA, 23 nt, artificial
  Chemically synthesized
ucccaguagucaaaaucacuuag

SEQ ID NO: 4056 - RNA, 23 nt, artificial
  Chemically synthesized
uuagcaggcucucugggugauag

SEQ ID NO: 4057 - RNA, 23 nt, artificial
  Chemically synthesized
uugaggaaagccgcaggacaucu

SEQ ID NO: 4058 - RNA, 23 nt, artificial
  Chemically synthesized
uuuagcugacuagcugaauaguu

SEQ ID NO: 4059 - RNA, 23 nt, artificial
  Chemically synthesized
uaacaauagacaugcaaaacaac

SEQ ID NO: 4060 - RNA, 23 nt, artificial
  Chemically synthesized
uguggaaucaaauguaaaacuca

SEQ ID NO: 4061 - RNA, 23 nt, artificial
  Chemically synthesized
acuagcugaauaguuuuacuacc

SEQ ID NO: 4062 - RNA, 23 nt, artificial
  Chemically synthesized
ugagauuaagcacauguaauacu

SEQ ID NO: 4063 - RNA, 23 nt, artificial
  Chemically synthesized
ucaccauuuuguaagcauaacag

SEQ ID NO: 4064 - RNA, 23 nt, artificial
  Chemically synthesized
uuguaagcauaacaggcaagaga

SEQ ID NO: 4065 - RNA, 23 nt, artificial
  Chemically synthesized
auaacacugccauggugaaaugg

SEQ ID NO: 4066 - RNA, 23 nt, artificial
  Chemically synthesized
ucgaaauccugagcugaggauca

SEQ ID NO: 4067 - RNA, 23 nt, artificial
  Chemically synthesized
ugcagaaaaucuacacuauuuug

SEQ ID NO: 4068 - RNA, 23 nt, artificial
  Chemically synthesized
gacaguucuccagcauuuuaacc

SEQ ID NO: 4069 - RNA, 23 nt, artificial
  Chemically synthesized
ucaacuacacacaaaaauaucag

SEQ ID NO: 4070 - RNA, 23 nt, artificial
  Chemically synthesized
aagcuuuaauuaaacucaccuac

SEQ ID NO: 4071 - RNA, 23 nt, artificial
  Chemically synthesized
agcauuugaagaguuuaguuugu

SEQ ID NO: 4072 - RNA, 23 nt, artificial
  Chemically synthesized
acaaguguaagcucaaaaguagg

SEQ ID NO: 4073 - RNA, 23 nt, artificial
  Chemically synthesized
ucaaauguaaaacucaaaugggc

SEQ ID NO: 4074 - RNA, 23 nt, artificial
  Chemically synthesized
auucacucaauggaagaguaauc

SEQ ID NO: 4075 - RNA, 23 nt, artificial
  Chemically synthesized
aucaccauuuuguaagcauaaca

SEQ ID NO: 4076 - RNA, 23 nt, artificial
  Chemically synthesized
uugcccagucaguggugacaacu

SEQ ID NO: 4077 - RNA, 23 nt, artificial
  Chemically synthesized
ucuaaaaacccuucaaauuugag

SEQ ID NO: 4078 - RNA, 23 nt, artificial
  Chemically synthesized
ucuccugaaaccagaggagaagc

SEQ ID NO: 4079 - RNA, 23 nt, artificial
  Chemically synthesized
aucagccuguuagcugcaguugc

SEQ ID NO: 4080 - RNA, 23 nt, artificial
  Chemically synthesized
acaccaggaugaauacaucuguc

SEQ ID NO: 4081 - RNA, 23 nt, artificial
  Chemically synthesized
ugaagcuaguccaugagcaguuc

SEQ ID NO: 4082 - RNA, 23 nt, artificial
  Chemically synthesized
uggaaguuuugauaggcuaaaua

SEQ ID NO: 4083 - RNA, 23 nt, artificial
  Chemically synthesized
aucaaauguaaaacucaaauggg

SEQ ID NO: 4084 - RNA, 23 nt, artificial
  Chemically synthesized
aacacaggcagguggcuucuuag

SEQ ID NO: 4085 - RNA, 23 nt, artificial
  Chemically synthesized
ugggcuuuuggaaguuuugauag

SEQ ID NO: 4086 - RNA, 23 nt, artificial
  Chemically synthesized
uucacucaauggaagaguaauca

SEQ ID NO: 4087 - RNA, 23 nt, artificial
  Chemically synthesized
uaccuaggguuaagcuuuaauua

SEQ ID NO: 4088 - RNA, 23 nt, artificial
  Chemically synthesized
ugaaguggagcuaauagcuaggg

SEQ ID NO: 4089 - RNA, 23 nt, artificial
  Chemically synthesized
accaggaugaauacaucuguccc

SEQ ID NO: 4090 - RNA, 23 nt, artificial
  Chemically synthesized
uuaccucguugagguuggguuca

SEQ ID NO: 4091 - RNA, 23 nt, artificial
  Chemically synthesized
ugggcuucuacuuuugcuuaccu

SEQ ID NO: 4092 - RNA, 23 nt, artificial
  Chemically synthesized
aagccuaccugaaaccaaauugu

SEQ ID NO: 4093 - RNA, 23 nt, artificial
  Chemically synthesized
uaagcauaacaggcaagagaguc

SEQ ID NO: 4094 - RNA, 23 nt, artificial
  Chemically synthesized
ugaaacacagaaagaaaagagac

SEQ ID NO: 4095 - RNA, 23 nt, artificial
  Chemically synthesized
aaauccugagcugaggaucagag

SEQ ID NO: 4096 - RNA, 23 nt, artificial
  Chemically synthesized
augagcaguucuccugcuuaaac

SEQ ID NO: 4097 - RNA, 23 nt, artificial
  Chemically synthesized
augggcuucuacuuuugcuuacc

SEQ ID NO: 4098 - RNA, 23 nt, artificial
  Chemically synthesized
uccugagcugaggaucagaguuc

SEQ ID NO: 4099 - RNA, 23 nt, artificial
  Chemically synthesized
uugcuaugaaugugaaacacaga

SEQ ID NO: 4100 - RNA, 23 nt, artificial
  Chemically synthesized
cuuaacaauagacaugcaaaaca

SEQ ID NO: 4101 - RNA, 23 nt, artificial
  Chemically synthesized
aacaggaucacaccuguuuuuca

SEQ ID NO: 4102 - RNA, 23 nt, artificial
  Chemically synthesized
agccauaugaaaaucaaaauagg

SEQ ID NO: 4103 - RNA, 23 nt, artificial
  Chemically synthesized
aacacuggcuaauuugaacagug

SEQ ID NO: 4104 - RNA, 23 nt, artificial
  Chemically synthesized
agaaagaaaagagacuacauuug

SEQ ID NO: 4105 - RNA, 23 nt, artificial
  Chemically synthesized
cugggugcaugcaugguuaucug

SEQ ID NO: 4106 - RNA, 23 nt, artificial
  Chemically synthesized
cuaguuuaaagacaguauucaac

SEQ ID NO: 4107 - RNA, 23 nt, artificial
  Chemically synthesized
auggcaccacaagcuuuuguugc

SEQ ID NO: 4108 - RNA, 23 nt, artificial
  Chemically synthesized
uaggcuguacuauaaaccauauc

SEQ ID NO: 4109 - RNA, 23 nt, artificial
  Chemically synthesized
aggcaaaucugguuuauauaguc

SEQ ID NO: 4110 - RNA, 23 nt, artificial
  Chemically synthesized
augaucuacuuaguuggaauaag

SEQ ID NO: 4111 - RNA, 23 nt, artificial
  Chemically synthesized
cugagauuaagcacauguaauac

SEQ ID NO: 4112 - RNA, 23 nt, artificial
  Chemically synthesized
cugacuagcugaauaguuuuacu

SEQ ID NO: 4113 - RNA, 23 nt, artificial
  Chemically synthesized
uguaagcauaacaggcaagagag

SEQ ID NO: 4114 - RNA, 23 nt, artificial
  Chemically synthesized
acuacccaaucaugaaauaaucu

SEQ ID NO: 4115 - RNA, 23 nt, artificial
  Chemically synthesized
agacaguucuccagcauuuuaac

SEQ ID NO: 4116 - RNA, 23 nt, artificial
  Chemically synthesized
uuagcugacuagcugaauaguuu

SEQ ID NO: 4117 - RNA, 23 nt, artificial
  Chemically synthesized
uaacaggaucacaccuguuuuuc

SEQ ID NO: 4118 - RNA, 23 nt, artificial
  Chemically synthesized
aagucaccaagaaacagugaagc

SEQ ID NO: 4119 - RNA, 23 nt, artificial
  Chemically synthesized
uucugaaaugcuggccggguucu

SEQ ID NO: 4120 - RNA, 23 nt, artificial
  Chemically synthesized
ugaacauuguugaguggaggcua

SEQ ID NO: 4121 - RNA, 23 nt, artificial
  Chemically synthesized
cuacacacaaaaauaucaguuca

SEQ ID NO: 4122 - RNA, 23 nt, artificial
  Chemically synthesized
uacugaaaagaggauagauuacu

SEQ ID NO: 4123 - RNA, 23 nt, artificial
  Chemically synthesized
guuaagcuuuaauuaaacucacc

SEQ ID NO: 4124 - RNA, 23 nt, artificial
  Chemically synthesized
ugaaagccuugcugaauugaaca

SEQ ID NO: 4125 - RNA, 23 nt, artificial
  Chemically synthesized
auacugaaaagaggauagauuac

SEQ ID NO: 4126 - RNA, 23 nt, artificial
  Chemically synthesized
uaugaaugugaaacacagaaaga

SEQ ID NO: 4127 - RNA, 23 nt, artificial
  Chemically synthesized
agcuuuaauuaaacucaccuacu

SEQ ID NO: 4128 - RNA, 23 nt, artificial
  Chemically synthesized
gacuagaucucagaacuaauuuc

SEQ ID NO: 4129 - RNA, 23 nt, artificial
  Chemically synthesized
aggccuuuauuauucccuaguga

SEQ ID NO: 4130 - RNA, 23 nt, artificial
  Chemically synthesized
augguuaucuggacggugaguuu

SEQ ID NO: 4131 - RNA, 23 nt, artificial
  Chemically synthesized
ugaggaagucaccaagaaacagu

SEQ ID NO: 4132 - RNA, 23 nt, artificial
  Chemically synthesized
aaagcccagagaugagauaacac

SEQ ID NO: 4133 - RNA, 23 nt, artificial
  Chemically synthesized
ugacauuuuaggucacuuauagu

SEQ ID NO: 4134 - RNA, 23 nt, artificial
  Chemically synthesized
uccagcaugugaaguggagcuaa

SEQ ID NO: 4135 - RNA, 23 nt, artificial
  Chemically synthesized
uggcuaauuugaacagugacauu

SEQ ID NO: 4136 - RNA, 23 nt, artificial
  Chemically synthesized
aaggagagauacuucaauuccca

SEQ ID NO: 4137 - RNA, 23 nt, artificial
  Chemically synthesized
uagcugacuagcugaauaguuuu

SEQ ID NO: 4138 - RNA, 23 nt, artificial
  Chemically synthesized
cugaauugaacauuguugagugg

SEQ ID NO: 4139 - RNA, 23 nt, artificial
  Chemically synthesized
cuuagagaaaaaaaagccauaug

SEQ ID NO: 4140 - RNA, 23 nt, artificial
  Chemically synthesized
uacucuuaccuaggguuaagcuu

SEQ ID NO: 4141 - RNA, 23 nt, artificial
  Chemically synthesized
ugauagccacaguccagcaauuc

SEQ ID NO: 4142 - RNA, 23 nt, artificial
  Chemically synthesized
cccaguagucaaaaucacuuagc

SEQ ID NO: 4143 - RNA, 23 nt, artificial
  Chemically synthesized
aguaacaggaucacaccuguuuu

SEQ ID NO: 4144 - RNA, 23 nt, artificial
  Chemically synthesized
aaagccgcaggacaucuugagca

SEQ ID NO: 4145 - RNA, 23 nt, artificial
  Chemically synthesized
ucacaccuguuuuucaguaacac

SEQ ID NO: 4146 - RNA, 23 nt, artificial
  Chemically synthesized
auccugagcugaggaucagaguu

SEQ ID NO: 4147 - RNA, 23 nt, artificial
  Chemically synthesized
aacaccaggaugaauacaucugu

SEQ ID NO: 4148 - RNA, 23 nt, artificial
  Chemically synthesized
ugagcaguucuccugcuuaaaca

SEQ ID NO: 4149 - RNA, 23 nt, artificial
  Chemically synthesized
ucaccaagaaacagugaagcagu

SEQ ID NO: 4150 - RNA, 23 nt, artificial
  Chemically synthesized
uaaacacaggcagguggcuucuu

SEQ ID NO: 4151 - RNA, 23 nt, artificial
  Chemically synthesized
cccguuucaauaauucaaagugg

SEQ ID NO: 4152 - RNA, 23 nt, artificial
  Chemically synthesized
aggaaagccgcaggacaucuuga

SEQ ID NO: 4153 - RNA, 23 nt, artificial
  Chemically synthesized
ggcuguacuauaaaccauaucuc

SEQ ID NO: 4154 - RNA, 23 nt, artificial
  Chemically synthesized
ucuccugcuuaaacacaagugua

SEQ ID NO: 4155 - RNA, 23 nt, artificial
  Chemically synthesized
gaggauagauuacuaagugaauc

SEQ ID NO: 4156 - RNA, 23 nt, artificial
  Chemically synthesized
accgugguuacugaaauggcacc

SEQ ID NO: 4157 - RNA, 23 nt, artificial
  Chemically synthesized
agacaugcaaaacaacauugauu

SEQ ID NO: 4158 - RNA, 23 nt, artificial
  Chemically synthesized
aacagugaagcaguuccauuauu

SEQ ID NO: 4159 - RNA, 23 nt, artificial
  Chemically synthesized
auccacgacccacagcaaggaua

SEQ ID NO: 4160 - RNA, 23 nt, artificial
  Chemically synthesized
accugaaaccaaauuguggaauc

SEQ ID NO: 4161 - RNA, 23 nt, artificial
  Chemically synthesized
ugacuagcugaauaguuuuacua

SEQ ID NO: 4162 - RNA, 23 nt, artificial
  Chemically synthesized
aaccaaauuguggaaucaaaugu

SEQ ID NO: 4163 - RNA, 23 nt, artificial
  Chemically synthesized
acagcaaggauaugaaagccuug

SEQ ID NO: 4164 - RNA, 23 nt, artificial
  Chemically synthesized
ucuacacuauuuugaaucacuuc

SEQ ID NO: 4165 - RNA, 23 nt, artificial
  Chemically synthesized
aguugcuaugaaugugaaacaca

SEQ ID NO: 4166 - RNA, 23 nt, artificial
  Chemically synthesized
ugcaguugcuaugaaugugaaac

SEQ ID NO: 4167 - RNA, 23 nt, artificial
  Chemically synthesized
ucccagaaaagcccagagaugag

SEQ ID NO: 4168 - RNA, 23 nt, artificial
  Chemically synthesized
ugaucuacuuaguuggaauaaga

SEQ ID NO: 4169 - RNA, 23 nt, artificial
  Chemically synthesized
cuaggguuaagcuuuaauuaaac

SEQ ID NO: 4170 - RNA, 23 nt, artificial
  Chemically synthesized
uuagcugcaguugcuaugaaugu

SEQ ID NO: 4171 - RNA, 23 nt, artificial
  Chemically synthesized
ucacucaauggaagaguaaucaa

SEQ ID NO: 4172 - RNA, 23 nt, artificial
  Chemically synthesized
gugcauaacacaaccucgcaagc

SEQ ID NO: 4173 - RNA, 23 nt, artificial
  Chemically synthesized
guaaacacaggcagguggcuucu

SEQ ID NO: 4174 - RNA, 23 nt, artificial
  Chemically synthesized
acagaaagaaaagagacuacauu

SEQ ID NO: 4175 - RNA, 23 nt, artificial
  Chemically synthesized
aaacacaggcagguggcuucuua

SEQ ID NO: 4176 - RNA, 23 nt, artificial
  Chemically synthesized
gaagcuaguccaugagcaguucu

SEQ ID NO: 4177 - RNA, 23 nt, artificial
  Chemically synthesized
auaggcaaaucugguuuauauag

SEQ ID NO: 4178 - RNA, 23 nt, artificial
  Chemically synthesized
cugguuuauauagucuauuacca

SEQ ID NO: 4179 - RNA, 23 nt, artificial
  Chemically synthesized
aaacaacauugauuuaucuuggc

SEQ ID NO: 4180 - RNA, 23 nt, artificial
  Chemically synthesized
cugugauuuaaaaaauccucuga

SEQ ID NO: 4181 - RNA, 23 nt, artificial
  Chemically synthesized
gaaguuuugauaggcuaaauauc

SEQ ID NO: 4182 - RNA, 23 nt, artificial
  Chemically synthesized
cugagcugaggaucagaguucuc

SEQ ID NO: 4183 - RNA, 23 nt, artificial
  Chemically synthesized
gaggaagucaccaagaaacagug

SEQ ID NO: 4184 - RNA, 23 nt, artificial
  Chemically synthesized
ugccguaauauuucucauuuacu

SEQ ID NO: 4185 - RNA, 23 nt, artificial
  Chemically synthesized
uaggcaaaucugguuuauauagu

SEQ ID NO: 4186 - RNA, 23 nt, artificial
  Chemically synthesized
caagccuaccugaaaccaaauug

SEQ ID NO: 4187 - RNA, 23 nt, artificial
  Chemically synthesized
ggcagaaacacagugaaccuuug

SEQ ID NO: 4188 - RNA, 23 nt, artificial
  Chemically synthesized
gauaacacugccauggugaaaug

SEQ ID NO: 4189 - RNA, 23 nt, artificial
  Chemically synthesized
uccaaucagugaguaaaguuuuu

SEQ ID NO: 4190 - RNA, 23 nt, artificial
  Chemically synthesized
acacagaaagaaaagagacuaca

SEQ ID NO: 4191 - RNA, 23 nt, artificial
  Chemically synthesized
cacaccuguuuuucaguaacacc

SEQ ID NO: 4192 - RNA, 23 nt, artificial
  Chemically synthesized
caguauucaacacuuaagaacag

SEQ ID NO: 4193 - RNA, 23 nt, artificial
  Chemically synthesized
caaucagugaguaaaguuuuuuc

SEQ ID NO: 4194 - RNA, 23 nt, artificial
  Chemically synthesized
acuacacacaaaaauaucaguuc

SEQ ID NO: 4195 - RNA, 23 nt, artificial
  Chemically synthesized
aggacaacaguucuacaucgaug

SEQ ID NO: 4196 - RNA, 23 nt, artificial
  Chemically synthesized
acaaggaccuuugagcaaccaag

SEQ ID NO: 4197 - RNA, 23 nt, artificial
  Chemically synthesized
agagauaaugaucuacuuaguug

SEQ ID NO: 4198 - RNA, 23 nt, artificial
  Chemically synthesized
acagacaguucuccagcauuuua

SEQ ID NO: 4199 - RNA, 23 nt, artificial
  Chemically synthesized
gaaaccugaauaagcuccuuauc

SEQ ID NO: 4200 - RNA, 23 nt, artificial
  Chemically synthesized
aaccauggucaacggcucuguuu

SEQ ID NO: 4201 - RNA, 23 nt, artificial
  Chemically synthesized
caguagucaaaaucacuuagcag

SEQ ID NO: 4202 - RNA, 23 nt, artificial
  Chemically synthesized
cucuuuaaaacauuagagugagg

SEQ ID NO: 4203 - RNA, 23 nt, artificial
  Chemically synthesized
uaaacacaaguguaagcucaaaa

SEQ ID NO: 4204 - RNA, 23 nt, artificial
  Chemically synthesized
acaggaucacaccuguuuuucag

SEQ ID NO: 4205 - RNA, 23 nt, artificial
  Chemically synthesized
aagccaucaccauuuuguaagca

SEQ ID NO: 4206 - RNA, 23 nt, artificial
  Chemically synthesized
gguuaagcuuuaauuaaacucac

SEQ ID NO: 4207 - RNA, 23 nt, artificial
  Chemically synthesized
aacagccuuccauaagccaucac

SEQ ID NO: 4208 - RNA, 23 nt, artificial
  Chemically synthesized
acccguuucaauaauucaaagug

SEQ ID NO: 4209 - RNA, 23 nt, artificial
  Chemically synthesized
acagcggcagaaacacagugaac

SEQ ID NO: 4210 - RNA, 23 nt, artificial
  Chemically synthesized
ucugaaaugcuggccggguucuu

SEQ ID NO: 4211 - RNA, 23 nt, artificial
  Chemically synthesized
aucauucacucaauggaagagua

SEQ ID NO: 4212 - RNA, 23 nt, artificial
  Chemically synthesized
ugggucaguuucucagggacaag

SEQ ID NO: 4213 - RNA, 23 nt, artificial
  Chemically synthesized
ugaggaaagccgcaggacaucuu

SEQ ID NO: 4214 - RNA, 23 nt, artificial
  Chemically synthesized
aaacacagaaagaaaagagacua

SEQ ID NO: 4215 - RNA, 23 nt, artificial
  Chemically synthesized
aguuuaaagacaguauucaacac

SEQ ID NO: 4216 - RNA, 23 nt, artificial
  Chemically synthesized
ucagccuguuagcugcaguugcu

SEQ ID NO: 4217 - RNA, 23 nt, artificial
  Chemically synthesized
ccagcuuuuuacauacauuuuca

SEQ ID NO: 4218 - RNA, 23 nt, artificial
  Chemically synthesized
ugugaaacacagaaagaaaagag

SEQ ID NO: 4219 - RNA, 23 nt, artificial
  Chemically synthesized
aaguggagcuaauagcuagggca

SEQ ID NO: 4220 - RNA, 23 nt, artificial
  Chemically synthesized
ugagcaaccaaguuuaguuugcu

SEQ ID NO: 4221 - RNA, 23 nt, artificial
  Chemically synthesized
acuuuagcugacuagcugaauag

SEQ ID NO: 4222 - RNA, 23 nt, artificial
  Chemically synthesized
aaccagaggagaagcgaccucua

SEQ ID NO: 4223 - RNA, 23 nt, artificial
  Chemically synthesized
aggaacugguggugugggcuuuu

SEQ ID NO: 4224 - RNA, 23 nt, artificial
  Chemically synthesized
gucaguuucucagggacaaggac

SEQ ID NO: 4225 - RNA, 23 nt, artificial
  Chemically synthesized
accaagaaacagugaagcaguuc

SEQ ID NO: 4226 - RNA, 23 nt, artificial
  Chemically synthesized
caaccauggucaacggcucuguu

SEQ ID NO: 4227 - RNA, 23 nt, artificial
  Chemically synthesized
auggaagaguaaucaacuacaca

SEQ ID NO: 4228 - RNA, 23 nt, artificial
  Chemically synthesized
uaccucguugagguuggguucag

SEQ ID NO: 4229 - RNA, 23 nt, artificial
  Chemically synthesized
agagauacuucaauucccagaaa

SEQ ID NO: 4230 - RNA, 23 nt, artificial
  Chemically synthesized
acccacagcaaggauaugaaagc

SEQ ID NO: 4231 - RNA, 23 nt, artificial
  Chemically synthesized
gauagauuacuaagugaaucaga

SEQ ID NO: 4232 - RNA, 23 nt, artificial
  Chemically synthesized
acaacaccgugguuacugaaaug

SEQ ID NO: 4233 - RNA, 23 nt, artificial
  Chemically synthesized
aaagccuugcugaauugaacauu

SEQ ID NO: 4234 - RNA, 23 nt, artificial
  Chemically synthesized
ucuccagcaugugaaguggagcu

SEQ ID NO: 4235 - RNA, 23 nt, artificial
  Chemically synthesized
ugagcaauucucugggucaguuu

SEQ ID NO: 4236 - RNA, 23 nt, artificial
  Chemically synthesized
uccugcuuaaacacaaguguaag

SEQ ID NO: 4237 - RNA, 23 nt, artificial
  Chemically synthesized
acacagugaaccuuuggagcuua

SEQ ID NO: 4238 - RNA, 23 nt, artificial
  Chemically synthesized
aacacaaguguaagcucaaaagu

SEQ ID NO: 4239 - RNA, 23 nt, artificial
  Chemically synthesized
aucacaccuguuuuucaguaaca

SEQ ID NO: 4240 - RNA, 23 nt, artificial
  Chemically synthesized
acagguauccaagguggaaaaaa

SEQ ID NO: 4241 - RNA, 23 nt, Artificial Sequence
  Chemically synthesized
ucauucacucaauggaagaguaa

SEQ ID NO: 4242 - RNA, 23 nt, artificial
  Chemically synthesized
caguguucuaacaaacuaaacuc

SEQ ID NO: 4243 - RNA, 23 nt, artificial
  Chemically synthesized
ccaguguucuaacaaacuaaacu

SEQ ID NO: 4244 - RNA, 23 nt, artificial
  Chemically synthesized
gccaguguucuaacaaacuaaac

SEQ ID NO: 4245 - RNA, 23 nt, artificial
  Chemically synthesized
agccaguguucuaacaaacuaaa

SEQ ID NO: 4246 - RNA, 23 nt, artificial
  Chemically synthesized
uagccaguguucuaacaaacuaa

SEQ ID NO: 4247 - RNA, 23 nt, artificial
  Chemically synthesized
uuagccaguguucuaacaaacua

SEQ ID NO: 4248 - RNA, 23 nt, artificial
  Chemically synthesized
ggauuauguuguuccugaaccca

SEQ ID NO: 4249 - RNA, 23 nt, artificial
  Chemically synthesized
gggauuauguuguuccugaaccc

SEQ ID NO: 4250 - RNA, 23 nt, artificial
  Chemically synthesized
ugggauuauguuguuccugaacc

SEQ ID NO: 4251 - RNA, 23 nt, artificial
  Chemically synthesized
cugggauuauguuguuccugaac

SEQ ID NO: 4252 - RNA, 23 nt, artificial
  Chemically synthesized
acugggauuauguuguuccugaa

SEQ ID NO: 4253 - RNA, 23 nt, artificial
  Chemically synthesized
ggcuuuucugggaauugaaguau

SEQ ID NO: 4254 - RNA, 23 nt, artificial
  Chemically synthesized
gggcuuuucugggaauugaagua

SEQ ID NO: 4255 - RNA, 23 nt, artificial
  Chemically synthesized
ugggcuuuucugggaauugaagu

SEQ ID NO: 4256 - RNA, 23 nt, artificial
  Chemically synthesized
cugggcuuuucugggaauugaag

SEQ ID NO: 4257 - RNA, 23 nt, artificial
  Chemically synthesized
ucugggcuuuucugggaauugaa

SEQ ID NO: 4258 - RNA, 23 nt, artificial
  Chemically synthesized
gauggaauagguaagcaaaagua

SEQ ID NO: 4259 - RNA, 23 nt, artificial
  Chemically synthesized
ggauggaauagguaagcaaaagu

SEQ ID NO: 4260 - RNA, 23 nt, artificial
  Chemically synthesized
gggauggaauagguaagcaaaag

SEQ ID NO: 4261 - RNA, 23 nt, artificial
  Chemically synthesized
ugggauggaauagguaagcaaaa

SEQ ID NO: 4262 - RNA, 23 nt, artificial
  Chemically synthesized
augggauggaauagguaagcaaa

SEQ ID NO: 4263 - RNA, 23 nt, artificial
  Chemically synthesized
cgugaacuuggaaauugaaaaug

SEQ ID NO: 4264 - RNA, 23 nt, artificial
  Chemically synthesized
acgugaacuuggaaauugaaaau

SEQ ID NO: 4265 - RNA, 23 nt, artificial
  Chemically synthesized
cacgugaacuuggaaauugaaaa

SEQ ID NO: 4266 - RNA, 23 nt, artificial
  Chemically synthesized
gcacgugaacuuggaaauugaaa

SEQ ID NO: 4267 - RNA, 23 nt, artificial
  Chemically synthesized
ugcacgugaacuuggaaauugaa

SEQ ID NO: 4268 - RNA, 23 nt, artificial
  Chemically synthesized
aaugggauggaauagguaagcaa

SEQ ID NO: 4269 - RNA, 23 nt, artificial
  Chemically synthesized
auuagccaguguucuaacaaacu

SEQ ID NO: 4270 - RNA, 23 nt, artificial
  Chemically synthesized
aauuagccaguguucuaacaaac

SEQ ID NO: 4271 - RNA, 23 nt, artificial
  Chemically synthesized
aaauuagccaguguucuaacaaa

SEQ ID NO: 4272 - RNA, 23 nt, artificial
  Chemically synthesized
gauugaaggguccuaaaaaggga

SEQ ID NO: 4273 - RNA, 23 nt, artificial
  Chemically synthesized
ugauugaaggguccuaaaaaggg

SEQ ID NO: 4274 - RNA, 23 nt, artificial
  Chemically synthesized
gugauugaaggguccuaaaaagg

SEQ ID NO: 4275 - RNA, 23 nt, artificial
  Chemically synthesized
agugauugaaggguccuaaaaag

SEQ ID NO: 4276 - RNA, 23 nt, artificial
  Chemically synthesized
cagugauugaaggguccuaaaaa

SEQ ID NO: 4277 - RNA, 23 nt, artificial
  Chemically synthesized
gaaugaugaauaccugugaggau

SEQ ID NO: 4278 - RNA, 23 nt, artificial
  Chemically synthesized
ugaaugaugaauaccugugagga

SEQ ID NO: 4279 - RNA, 23 nt, artificial
  Chemically synthesized
gugaaugaugaauaccugugagg

SEQ ID NO: 4280 - RNA, 23 nt, artificial
  Chemically synthesized
agugaaugaugaauaccugugag

SEQ ID NO: 4281 - RNA, 23 nt, artificial
  Chemically synthesized
gagugaaugaugaauaccuguga

SEQ ID NO: 4282 - RNA, 23 nt, artificial
  Chemically synthesized
cagagagccugcuaagugauuuu

SEQ ID NO: 4283 - RNA, 23 nt, artificial
  Chemically synthesized
ccagagagccugcuaagugauuu

SEQ ID NO: 4284 - RNA, 23 nt, artificial
  Chemically synthesized
cccagagagccugcuaagugauu

SEQ ID NO: 4285 - RNA, 23 nt, artificial
  Chemically synthesized
acccagagagccugcuaagugau

SEQ ID NO: 4286 - RNA, 23 nt, artificial
  Chemically synthesized
cacccagagagccugcuaaguga

SEQ ID NO: 4287 - RNA, 23 nt, artificial
  Chemically synthesized
agaauugggccaagauaaaucaa

SEQ ID NO: 4288 - RNA, 23 nt, artificial
  Chemically synthesized
uagaauugggccaagauaaauca

SEQ ID NO: 4289 - RNA, 23 nt, artificial
  Chemically synthesized
auagaauugggccaagauaaauc

SEQ ID NO: 4290 - RNA, 23 nt, artificial
  Chemically synthesized
uauagaauugggccaagauaaau

SEQ ID NO: 4291 - RNA, 23 nt, artificial
  Chemically synthesized
uuauagaauugggccaagauaaa

SEQ ID NO: 4292 - RNA, 23 nt, artificial
  Chemically synthesized
ugcugugggucguggauaaggag

SEQ ID NO: 4293 - RNA, 23 nt, artificial
  Chemically synthesized
uugcugugggucguggauaagga

SEQ ID NO: 4294 - RNA, 23 nt, artificial
  Chemically synthesized
cuugcugugggucguggauaagg

SEQ ID NO: 4295 - RNA, 23 nt, artificial
  Chemically synthesized
ccuugcugugggucguggauaag

SEQ ID NO: 4296 - RNA, 23 nt, artificial
  Chemically synthesized
uccuugcugugggucguggauaa

SEQ ID NO: 4297 - RNA, 23 nt, artificial
  Chemically synthesized
agguaagaguaaaugagaaauau

SEQ ID NO: 4298 - RNA, 23 nt, artificial
  Chemically synthesized
uagguaagaguaaaugagaaaua

SEQ ID NO: 4299 - RNA, 23 nt, artificial
  Chemically synthesized
cuagguaagaguaaaugagaaau

SEQ ID NO: 4300 - RNA, 23 nt, artificial
  Chemically synthesized
ccuagguaagaguaaaugagaaa

SEQ ID NO: 4301 - RNA, 23 nt, artificial
  Chemically synthesized
cccuagguaagaguaaaugagaa

SEQ ID NO: 4302 - RNA, 23 nt, artificial
  Chemically synthesized
cuguccaaaucaaagcaaacuaa

SEQ ID NO: 4303 - RNA, 23 nt, artificial
  Chemically synthesized
ucuguccaaaucaaagcaaacua

SEQ ID NO: 4304 - RNA, 23 nt, artificial
  Chemically synthesized
gucuguccaaaucaaagcaaacu

SEQ ID NO: 4305 - RNA, 23 nt, artificial
  Chemically synthesized
ugucuguccaaaucaaagcaaac

SEQ ID NO: 4306 - RNA, 23 nt, artificial
  Chemically synthesized
cugucuguccaaaucaaagcaaa

SEQ ID NO: 4307 - RNA, 23 nt, artificial
  Chemically synthesized
ucaugauuggguaguaaaacuau

SEQ ID NO: 4308 - RNA, 23 nt, artificial
  Chemically synthesized
uucaugauuggguaguaaaacua

SEQ ID NO: 4309 - RNA, 23 nt, artificial
  Chemically synthesized
uuucaugauuggguaguaaaacu

SEQ ID NO: 4310 - RNA, 23 nt, artificial
  Chemically synthesized
auuucaugauuggguaguaaaac

SEQ ID NO: 4311 - RNA, 23 nt, artificial
  Chemically synthesized
uauuucaugauuggguaguaaaa

SEQ ID NO: 4312 - RNA, 23 nt, artificial
  Chemically synthesized
acagugauugaaggguccuaaaa

SEQ ID NO: 4313 - RNA, 23 nt, artificial
  Chemically synthesized
aacagugauugaaggguccuaaa

SEQ ID NO: 4314 - RNA, 23 nt, artificial
  Chemically synthesized
ggaaggcuguuaaauuaauauuc

SEQ ID NO: 4315 - RNA, 23 nt, artificial
  Chemically synthesized
uggaaggcuguuaaauuaauauu

SEQ ID NO: 4316 - RNA, 23 nt, artificial
  Chemically synthesized
auggaaggcuguuaaauuaauau

SEQ ID NO: 4317 - RNA, 23 nt, artificial
  Chemically synthesized
uauggaaggcuguuaaauuaaua

SEQ ID NO: 4318 - RNA, 23 nt, artificial
  Chemically synthesized
uuauggaaggcuguuaaauuaau

SEQ ID NO: 4319 - RNA, 23 nt, artificial
  Chemically synthesized
caaggguaguagcuguauacuac

SEQ ID NO: 4320 - RNA, 23 nt, artificial
  Chemically synthesized
ucaaggguaguagcuguauacua

SEQ ID NO: 4321 - RNA, 23 nt, artificial
  Chemically synthesized
gucaaggguaguagcuguauacu

SEQ ID NO: 4322 - RNA, 23 nt, artificial
  Chemically synthesized
ugucaaggguaguagcuguauac

SEQ ID NO: 4323 - RNA, 23 nt, artificial
  Chemically synthesized
uugucaaggguaguagcuguaua

SEQ ID NO: 4324 - RNA, 23 nt, artificial
  Chemically synthesized
ccaaaucaaagcaaacuaaacuu

SEQ ID NO: 4325 - RNA, 23 nt, artificial
  Chemically synthesized
uccaaaucaaagcaaacuaaacu

SEQ ID NO: 4326 - RNA, 23 nt, artificial
  Chemically synthesized
guccaaaucaaagcaaacuaaac

SEQ ID NO: 4327 - RNA, 23 nt, artificial
  Chemically synthesized
uguccaaaucaaagcaaacuaaa

SEQ ID NO: 4328 - RNA, 23 nt, artificial
  Chemically synthesized
gcuuauggaaggcuguuaaauua

SEQ ID NO: 4329 - RNA, 23 nt, artificial
  Chemically synthesized
ggcuuauggaaggcuguuaaauu

SEQ ID NO: 4330 - RNA, 23 nt, artificial
  Chemically synthesized
uggcuuauggaaggcuguuaaau

SEQ ID NO: 4331 - RNA, 23 nt, artificial
  Chemically synthesized
auggcuuauggaaggcuguuaaa

SEQ ID NO: 4332 - RNA, 23 nt, artificial
  Chemically synthesized
gauggcuuauggaaggcuguuaa

SEQ ID NO: 4333 - RNA, 23 nt, artificial
  Chemically synthesized
uccuguuacugauacuauaagug

SEQ ID NO: 4334 - RNA, 23 nt, artificial
  Chemically synthesized
auccuguuacugauacuauaagu

SEQ ID NO: 4335 - RNA, 23 nt, artificial
  Chemically synthesized
gauccuguuacugauacuauaag

SEQ ID NO: 4336 - RNA, 23 nt, artificial
  Chemically synthesized
ugauccuguuacugauacuauaa

SEQ ID NO: 4337 - RNA, 23 nt, artificial
  Chemically synthesized
gugauccuguuacugauacuaua

SEQ ID NO: 4338 - RNA, 23 nt, artificial
  Chemically synthesized
gguccuugucccugagaaacuga

SEQ ID NO: 4339 - RNA, 23 nt, artificial
  Chemically synthesized
agguccuugucccugagaaacug

SEQ ID NO: 4340 - RNA, 23 nt, artificial
  Chemically synthesized
aagguccuugucccugagaaacu

SEQ ID NO: 4341 - RNA, 23 nt, artificial
  Chemically synthesized
aaagguccuugucccugagaaac

SEQ ID NO: 4342 - RNA, 23 nt, artificial
  Chemically synthesized
caaagguccuugucccugagaaa

SEQ ID NO: 4343 - RNA, 23 nt, artificial
  Chemically synthesized
ccaacuaaguagaucauuaucuc

SEQ ID NO: 4344 - RNA, 23 nt, artificial
  Chemically synthesized
uccaacuaaguagaucauuaucu

SEQ ID NO: 4345 - RNA, 23 nt, artificial
  Chemically synthesized
uuccaacuaaguagaucauuauc

SEQ ID NO: 4346 - RNA, 23 nt, artificial
  Chemically synthesized
auuccaacuaaguagaucauuau

SEQ ID NO: 4347 - RNA, 23 nt, artificial
  Chemically synthesized
uauuccaacuaaguagaucauua

SEQ ID NO: 4348 - RNA, 23 nt, artificial
  Chemically synthesized
ugguuaaaaugcuggagaacugu

SEQ ID NO: 4349 - RNA, 23 nt, artificial
  Chemically synthesized
uugguuaaaaugcuggagaacug

SEQ ID NO: 4350 - RNA, 23 nt, artificial
  Chemically synthesized
uuugguuaaaaugcuggagaacu

SEQ ID NO: 4351 - RNA, 23 nt, artificial
  Chemically synthesized
auuugguuaaaaugcuggagaac

SEQ ID NO: 4352 - RNA, 23 nt, artificial
  Chemically synthesized
aauuugguuaaaaugcuggagaa

SEQ ID NO: 4353 - RNA, 23 nt, artificial
  Chemically synthesized
ccauugagugaaugaugaauacc

SEQ ID NO: 4354 - RNA, 23 nt, artificial
  Chemically synthesized
uccauugagugaaugaugaauac

SEQ ID NO: 4355 - RNA, 23 nt, artificial
  Chemically synthesized
uuccauugagugaaugaugaaua

SEQ ID NO: 4356 - RNA, 23 nt, artificial
  Chemically synthesized
cuuccauugagugaaugaugaau

SEQ ID NO: 4357 - RNA, 23 nt, artificial
  Chemically synthesized
ucuuccauugagugaaugaugaa

SEQ ID NO: 4358 - RNA, 23 nt, artificial
  Chemically synthesized
gaauuuagccuccacucaacaau

SEQ ID NO: 4359 - RNA, 23 nt, artificial
  Chemically synthesized
agaauuuagccuccacucaacaa

SEQ ID NO: 4360 - RNA, 23 nt, artificial
  Chemically synthesized
gagaauuuagccuccacucaaca

SEQ ID NO: 4361 - RNA, 23 nt, artificial
  Chemically synthesized
agagaauuuagccuccacucaac

SEQ ID NO: 4362 - RNA, 23 nt, artificial
  Chemically synthesized
gagagaauuuagccuccacucaa

SEQ ID NO: 4363 - RNA, 23 nt, artificial
  Chemically synthesized
caggauuucgacuuguuaagaaa

SEQ ID NO: 4364 - RNA, 23 nt, artificial
  Chemically synthesized
ucaggauuucgacuuguuaagaa

SEQ ID NO: 4365 - RNA, 23 nt, artificial
  Chemically synthesized
cucaggauuucgacuuguuaaga

SEQ ID NO: 4366 - RNA, 23 nt, artificial
  Chemically synthesized
gcucaggauuucgacuuguuaag

SEQ ID NO: 4367 - RNA, 23 nt, artificial
  Chemically synthesized
agcucaggauuucgacuuguuaa

SEQ ID NO: 4368 - RNA, 23 nt, artificial
  Chemically synthesized
augcacgugaacuuggaaauuga

SEQ ID NO: 4369 - RNA, 23 nt, artificial
  Chemically synthesized
gugugauccuguuacugauacua

SEQ ID NO: 4370 - RNA, 23 nt, artificial
  Chemically synthesized
ggugugauccuguuacugauacu

SEQ ID NO: 4371 - RNA, 23 nt, artificial
  Chemically synthesized
aggugugauccuguuacugauac

SEQ ID NO: 4372 - RNA, 23 nt, artificial
  Chemically synthesized
caggugugauccuguuacugaua

SEQ ID NO: 4373 - RNA, 23 nt, artificial
  Chemically synthesized
acaggugugauccuguuacugau

SEQ ID NO: 4374 - RNA, 23 nt, artificial
  Chemically synthesized
caguauuacaugugcuuaaucuc

SEQ ID NO: 4375 - RNA, 23 nt, artificial
  Chemically synthesized
ucaguauuacaugugcuuaaucu

SEQ ID NO: 4376 - RNA, 23 nt, artificial
  Chemically synthesized
uucaguauuacaugugcuuaauc

SEQ ID NO: 4377 - RNA, 23 nt, artificial
  Chemically synthesized
uuucaguauuacaugugcuuaau

SEQ ID NO: 4378 - RNA, 23 nt, artificial
  Chemically synthesized
uuuucaguauuacaugugcuuaa

SEQ ID NO: 4379 - RNA, 23 nt, artificial
  Chemically synthesized
ccaccugcccuaaauaagaaacc

SEQ ID NO: 4380 - RNA, 23 nt, artificial
  Chemically synthesized
cccaccugcccuaaauaagaaac

SEQ ID NO: 4381 - RNA, 23 nt, artificial
  Chemically synthesized
ccccaccugcccuaaauaagaaa

SEQ ID NO: 4382 - RNA, 23 nt, artificial
  Chemically synthesized
gccccaccugcccuaaauaagaa

SEQ ID NO: 4383 - RNA, 23 nt, artificial
  Chemically synthesized
ugccccaccugcccuaaauaaga

SEQ ID NO: 4384 - RNA, 23 nt, artificial
  Chemically synthesized
gguaagaguaaaugagaaauauu

SEQ ID NO: 4385 - RNA, 23 nt, artificial
  Chemically synthesized
ggagaacugucuguccaaaucaa

SEQ ID NO: 4386 - RNA, 23 nt, artificial
  Chemically synthesized
uggagaacugucuguccaaauca

SEQ ID NO: 4387 - RNA, 23 nt, artificial
  Chemically synthesized
cuggagaacugucuguccaaauc

SEQ ID NO: 4388 - RNA, 23 nt, artificial
  Chemically synthesized
gcuggagaacugucuguccaaau

SEQ ID NO: 4389 - RNA, 23 nt, artificial
  Chemically synthesized
ugcuggagaacugucuguccaaa

SEQ ID NO: 4390 - RNA, 23 nt, artificial
  Chemically synthesized
cgagguaauauuugaggaaucaa

SEQ ID NO: 4391 - RNA, 23 nt, artificial
  Chemically synthesized
acgagguaauauuugaggaauca

SEQ ID NO: 4392 - RNA, 23 nt, artificial
  Chemically synthesized
aacgagguaauauuugaggaauc

SEQ ID NO: 4393 - RNA, 23 nt, artificial
  Chemically synthesized
caacgagguaauauuugaggaau

SEQ ID NO: 4394 - RNA, 23 nt, artificial
  Chemically synthesized
ucaacgagguaauauuugaggaa

SEQ ID NO: 4395 - RNA, 23 nt, artificial
  Chemically synthesized
gcuuggaaagauacuacaaagcc

SEQ ID NO: 4396 - RNA, 23 nt, artificial
  Chemically synthesized
ugcuuggaaagauacuacaaagc

SEQ ID NO: 4397 - RNA, 23 nt, artificial
  Chemically synthesized
augcuuggaaagauacuacaaag

SEQ ID NO: 4398 - RNA, 23 nt, artificial
  Chemically synthesized
aaugcuuggaaagauacuacaaa

SEQ ID NO: 4399 - RNA, 23 nt, artificial
  Chemically synthesized
aaaugcuuggaaagauacuacaa

SEQ ID NO: 4400 - RNA, 23 nt, artificial
  Chemically synthesized
cuaaaaugucacuguucaaauua

SEQ ID NO: 4401 - RNA, 23 nt, artificial
  Chemically synthesized
ccuaaaaugucacuguucaaauu

SEQ ID NO: 4402 - RNA, 23 nt, artificial
  Chemically synthesized
accuaaaaugucacuguucaaau

SEQ ID NO: 4403 - RNA, 23 nt, artificial
  Chemically synthesized
gaccuaaaaugucacuguucaaa

SEQ ID NO: 4404 - RNA, 23 nt, artificial
  Chemically synthesized
ugaccuaaaaugucacuguucaa

SEQ ID NO: 4405 - RNA, 23 nt, artificial
  Chemically synthesized
gugacuuccucacucuaauguuu

SEQ ID NO: 4406 - RNA, 23 nt, artificial
  Chemically synthesized
ggugacuuccucacucuaauguu

SEQ ID NO: 4407 - RNA, 23 nt, artificial
  Chemically synthesized
uggugacuuccucacucuaaugu

SEQ ID NO: 4408 - RNA, 23 nt, artificial
  Chemically synthesized
uuggugacuuccucacucuaaug

SEQ ID NO: 4409 - RNA, 23 nt, artificial
  Chemically synthesized
cuuggugacuuccucacucuaau

SEQ ID NO: 4410 - RNA, 23 nt, artificial
  Chemically synthesized
gaaugggauggaauagguaagca

SEQ ID NO: 4411 - RNA, 23 nt, artificial
  Chemically synthesized
ugaaugggauggaauagguaagc

SEQ ID NO: 4412 - RNA, 23 nt, artificial
  Chemically synthesized
uugaaugggauggaauagguaag

SEQ ID NO: 4413 - RNA, 23 nt, artificial
  Chemically synthesized
auugaaugggauggaauagguaa

SEQ ID NO: 4414 - RNA, 23 nt, artificial
  Chemically synthesized
aauugaaugggauggaauaggua

SEQ ID NO: 4415 - RNA, 23 nt, artificial
  Chemically synthesized
gccuguuaugcuuacaaaauggu

SEQ ID NO: 4416 - RNA, 23 nt, artificial
  Chemically synthesized
ugccuguuaugcuuacaaaaugg

SEQ ID NO: 4417 - RNA, 23 nt, artificial
  Chemically synthesized
uugccuguuaugcuuacaaaaug

SEQ ID NO: 4418 - RNA, 23 nt, artificial
  Chemically synthesized
cuugccuguuaugcuuacaaaau

SEQ ID NO: 4419 - RNA, 23 nt, artificial
  Chemically synthesized
ucuugccuguuaugcuuacaaaa

SEQ ID NO: 4420 - RNA, 23 nt, artificial
  Chemically synthesized
agguaggcuugguaauagacuau

SEQ ID NO: 4421 - RNA, 23 nt, artificial
  Chemically synthesized
cagguaggcuugguaauagacua

SEQ ID NO: 4422 - RNA, 23 nt, artificial
  Chemically synthesized
ucagguaggcuugguaauagacu

SEQ ID NO: 4423 - RNA, 23 nt, artificial
  Chemically synthesized
uucagguaggcuugguaauagac

SEQ ID NO: 4424 - RNA, 23 nt, artificial
  Chemically synthesized
uuucagguaggcuugguaauaga

SEQ ID NO: 4425 - RNA, 23 nt, artificial
  Chemically synthesized
gaugaauaccugugaggauagga

SEQ ID NO: 4426 - RNA, 23 nt, artificial
  Chemically synthesized
ugaugaauaccugugaggauagg

SEQ ID NO: 4427 - RNA, 23 nt, artificial
  Chemically synthesized
augaugaauaccugugaggauag

SEQ ID NO: 4428 - RNA, 23 nt, artificial
  Chemically synthesized
aaugaugaauaccugugaggaua

SEQ ID NO: 4429 - RNA, 23 nt, artificial
  Chemically synthesized
cugucacuagggaauaauaaagg

SEQ ID NO: 4430 - RNA, 23 nt, artificial
  Chemically synthesized
ccugucacuagggaauaauaaag

SEQ ID NO: 4431 - RNA, 23 nt, artificial
  Chemically synthesized
accugucacuagggaauaauaaa

SEQ ID NO: 4432 - RNA, 23 nt, artificial
  Chemically synthesized
uaccugucacuagggaauaauaa

SEQ ID NO: 4433 - RNA, 23 nt, artificial
  Chemically synthesized
auaccugucacuagggaauaaua

SEQ ID NO: 4434 - RNA, 23 nt, artificial
  Chemically synthesized
guuuuaaagaggcaacaaaagcu

SEQ ID NO: 4435 - RNA, 23 nt, artificial
  Chemically synthesized
uguuuuaaagaggcaacaaaagc

SEQ ID NO: 4436 - RNA, 23 nt, artificial
  Chemically synthesized
auguuuuaaagaggcaacaaaag

SEQ ID NO: 4437 - RNA, 23 nt, artificial
  Chemically synthesized
aauguuuuaaagaggcaacaaaa

SEQ ID NO: 4438 - RNA, 23 nt, artificial
  Chemically synthesized
uaauguuuuaaagaggcaacaaa

SEQ ID NO: 4439 - RNA, 23 nt, artificial
  Chemically synthesized
guguucuaacaaacuaaacucuu

SEQ ID NO: 4440 - RNA, 23 nt, artificial
  Chemically synthesized
aguguucuaacaaacuaaacucu

SEQ ID NO: 4441 - RNA, 23 nt, artificial
  Chemically synthesized
gcuugguaauagacuauauaaac

SEQ ID NO: 4442 - RNA, 23 nt, artificial
  Chemically synthesized
ggcuugguaauagacuauauaaa

SEQ ID NO: 4443 - RNA, 23 nt, artificial
  Chemically synthesized
aggcuugguaauagacuauauaa

SEQ ID NO: 4444 - RNA, 23 nt, artificial
  Chemically synthesized
uaggcuugguaauagacuauaua

SEQ ID NO: 4445 - RNA, 23 nt, artificial
  Chemically synthesized
guaggcuugguaauagacuauau

SEQ ID NO: 4446 - RNA, 23 nt, artificial
  Chemically synthesized
cauccugguguuacugaaaaaca

SEQ ID NO: 4447 - RNA, 23 nt, artificial
  Chemically synthesized
ucauccugguguuacugaaaaac

SEQ ID NO: 4448 - RNA, 23 nt, artificial
  Chemically synthesized
uucauccugguguuacugaaaaa

SEQ ID NO: 4449 - RNA, 23 nt, artificial
  Chemically synthesized
auucauccugguguuacugaaaa

SEQ ID NO: 4450 - RNA, 23 nt, artificial
  Chemically synthesized
uauucauccugguguuacugaaa

SEQ ID NO: 4451 - RNA, 23 nt, artificial
  Chemically synthesized
gccuaucaaaacuuccaaaagcc

SEQ ID NO: 4452 - RNA, 23 nt, artificial
  Chemically synthesized
agccuaucaaaacuuccaaaagc

SEQ ID NO: 4453 - RNA, 23 nt, artificial
  Chemically synthesized
uagccuaucaaaacuuccaaaag

SEQ ID NO: 4454 - RNA, 23 nt, artificial
  Chemically synthesized
uuagccuaucaaaacuuccaaaa

SEQ ID NO: 4455 - RNA, 23 nt, artificial
  Chemically synthesized
uuuagccuaucaaaacuuccaaa

SEQ ID NO: 4456 - RNA, 23 nt, artificial
  Chemically synthesized
uccugguguuacugaaaaacagg

SEQ ID NO: 4457 - RNA, 23 nt, artificial
  Chemically synthesized
auccugguguuacugaaaaacag

SEQ ID NO: 4458 - RNA, 23 nt, artificial
  Chemically synthesized
ccacgguguuguuuuagaugccu

SEQ ID NO: 4459 - RNA, 23 nt, artificial
  Chemically synthesized
accacgguguuguuuuagaugcc

SEQ ID NO: 4460 - RNA, 23 nt, artificial
  Chemically synthesized
aaccacgguguuguuuuagaugc

SEQ ID NO: 4461 - RNA, 23 nt, artificial
  Chemically synthesized
uaaccacgguguuguuuuagaug

SEQ ID NO: 4462 - RNA, 23 nt, artificial
  Chemically synthesized
guaaccacgguguuguuuuagau

SEQ ID NO: 4463 - RNA, 23 nt, artificial
  Chemically synthesized
acaaaauggugauggcuuaugga

SEQ ID NO: 4464 - RNA, 23 nt, artificial
  Chemically synthesized
uacaaaauggugauggcuuaugg

SEQ ID NO: 4465 - RNA, 23 nt, artificial
  Chemically synthesized
uuacaaaauggugauggcuuaug

SEQ ID NO: 4466 - RNA, 23 nt, artificial
  Chemically synthesized
cuuacaaaauggugauggcuuau

SEQ ID NO: 4467 - RNA, 23 nt, artificial
  Chemically synthesized
gcuuacaaaauggugauggcuua

SEQ ID NO: 4468 - RNA, 23 nt, artificial
  Chemically synthesized
gcaguuugagcagcaagaacccg

SEQ ID NO: 4469 - RNA, 23 nt, artificial
  Chemically synthesized
ggcaguuugagcagcaagaaccc

SEQ ID NO: 4470 - RNA, 23 nt, artificial
  Chemically synthesized
uggcaguuugagcagcaagaacc

SEQ ID NO: 4471 - RNA, 23 nt, artificial
  Chemically synthesized
cuggcaguuugagcagcaagaac

SEQ ID NO: 4472 - RNA, 23 nt, artificial
  Chemically synthesized
acuggcaguuugagcagcaagaa

SEQ ID NO: 4473 - RNA, 23 nt, artificial
  Chemically synthesized
cuuggaaagauacuacaaagcca

SEQ ID NO: 4474 - RNA, 23 nt, artificial
  Chemically synthesized
gugugauucuagcgucguaccua

SEQ ID NO: 4475 - RNA, 23 nt, artificial
  Chemically synthesized
ugugugauucuagcgucguaccu

SEQ ID NO: 4476 - RNA, 23 nt, artificial
  Chemically synthesized
gugugugauucuagcgucguacc

SEQ ID NO: 4477 - RNA, 23 nt, artificial
  Chemically synthesized
ugugugugauucuagcgucguac

SEQ ID NO: 4478 - RNA, 23 nt, artificial
  Chemically synthesized
uugugugugauucuagcgucgua

SEQ ID NO: 4479 - RNA, 23 nt, artificial
  Chemically synthesized
cuugggcaucgauguagaacugu

SEQ ID NO: 4480 - RNA, 23 nt, artificial
  Chemically synthesized
ucuugggcaucgauguagaacug

SEQ ID NO: 4481 - RNA, 23 nt, artificial
  Chemically synthesized
uucuugggcaucgauguagaacu

SEQ ID NO: 4482 - RNA, 23 nt, artificial
  Chemically synthesized
cuucuugggcaucgauguagaac

SEQ ID NO: 4483 - RNA, 23 nt, artificial
  Chemically synthesized
gcuucuugggcaucgauguagaa

SEQ ID NO: 4484 - RNA, 23 nt, artificial
  Chemically synthesized
cucugggcuuuucugggaauuga

SEQ ID NO: 4485 - RNA, 23 nt, artificial
  Chemically synthesized
aacugucuguccaaaucaaagca

SEQ ID NO: 4486 - RNA, 23 nt, artificial
  Chemically synthesized
gaacugucuguccaaaucaaagc

SEQ ID NO: 4487 - RNA, 23 nt, artificial
  Chemically synthesized
agaacugucuguccaaaucaaag

SEQ ID NO: 4488 - RNA, 23 nt, artificial
  Chemically synthesized
gagaacugucuguccaaaucaaa

SEQ ID NO: 4489 - RNA, 23 nt, artificial
  Chemically synthesized
gaaggguccuaaaaagggaaaau

SEQ ID NO: 4490 - RNA, 23 nt, artificial
  Chemically synthesized
ugaaggguccuaaaaagggaaaa

SEQ ID NO: 4491 - RNA, 23 nt, artificial
  Chemically synthesized
uugaaggguccuaaaaagggaaa

SEQ ID NO: 4492 - RNA, 23 nt, artificial
  Chemically synthesized
auugaaggguccuaaaaagggaa

SEQ ID NO: 4493 - RNA, 23 nt, artificial
  Chemically synthesized
aaagcuuaacccuagguaagagu

SEQ ID NO: 4494 - RNA, 23 nt, artificial
  Chemically synthesized
uaaagcuuaacccuagguaagag

SEQ ID NO: 4495 - RNA, 23 nt, artificial
  Chemically synthesized
uuaaagcuuaacccuagguaaga

SEQ ID NO: 4496 - RNA, 23 nt, artificial
  Chemically synthesized
auuaaagcuuaacccuagguaag

SEQ ID NO: 4497 - RNA, 23 nt, artificial
  Chemically synthesized
aauuaaagcuuaacccuagguaa

SEQ ID NO: 4498 - RNA, 23 nt, artificial
  Chemically synthesized
acaugugcuuaaucucagaugaa

SEQ ID NO: 4499 - RNA, 23 nt, artificial
  Chemically synthesized
uacaugugcuuaaucucagauga

SEQ ID NO: 4500 - RNA, 23 nt, artificial
  Chemically synthesized
uuacaugugcuuaaucucagaug

SEQ ID NO: 4501 - RNA, 23 nt, artificial
  Chemically synthesized
auuacaugugcuuaaucucagau

SEQ ID NO: 4502 - RNA, 23 nt, artificial
  Chemically synthesized
uauuacaugugcuuaaucucaga

SEQ ID NO: 4503 - RNA, 23 nt, artificial
  Chemically synthesized
gaaucaacuugccagaauuuggu

SEQ ID NO: 4504 - RNA, 23 nt, artificial
  Chemically synthesized
ggaaucaacuugccagaauuugg

SEQ ID NO: 4505 - RNA, 23 nt, artificial
  Chemically synthesized
aggaaucaacuugccagaauuug

SEQ ID NO: 4506 - RNA, 23 nt, artificial
  Chemically synthesized
gaggaaucaacuugccagaauuu

SEQ ID NO: 4507 - RNA, 23 nt, artificial
  Chemically synthesized
ugaggaaucaacuugccagaauu

SEQ ID NO: 4508 - RNA, 23 nt, artificial
  Chemically synthesized
uccucacucuaauguuuuaaaga

SEQ ID NO: 4509 - RNA, 23 nt, artificial
  Chemically synthesized
uuccucacucuaauguuuuaaag

SEQ ID NO: 4510 - RNA, 23 nt, artificial
  Chemically synthesized
cuuccucacucuaauguuuuaaa

SEQ ID NO: 4511 - RNA, 23 nt, artificial
  Chemically synthesized
acuuccucacucuaauguuuuaa

SEQ ID NO: 4512 - RNA, 23 nt, artificial
  Chemically synthesized
gacuuccucacucuaauguuuua

SEQ ID NO: 4513 - RNA, 23 nt, artificial
  Chemically synthesized
gaaagauacuacaaagccaaucu

SEQ ID NO: 4514 - RNA, 23 nt, artificial
  Chemically synthesized
ggaaagauacuacaaagccaauc

SEQ ID NO: 4515 - RNA, 23 nt, artificial
  Chemically synthesized
uggaaagauacuacaaagccaau

SEQ ID NO: 4516 - RNA, 23 nt, artificial
  Chemically synthesized
uuggaaagauacuacaaagccaa

SEQ ID NO: 4517 - RNA, 23 nt, artificial
  Chemically synthesized
aaggguuuuuagacaggaaggua

SEQ ID NO: 4518 - RNA, 23 nt, artificial
  Chemically synthesized
gaaggguuuuuagacaggaaggu

SEQ ID NO: 4519 - RNA, 23 nt, artificial
  Chemically synthesized
ugaaggguuuuuagacaggaagg

SEQ ID NO: 4520 - RNA, 23 nt, artificial
  Chemically synthesized
uugaaggguuuuuagacaggaag

SEQ ID NO: 4521 - RNA, 23 nt, artificial
  Chemically synthesized
uuugaaggguuuuuagacaggaa

SEQ ID NO: 4522 - RNA, 23 nt, artificial
  Chemically synthesized
guauucauccugguguuacugaa

SEQ ID NO: 4523 - RNA, 23 nt, artificial
  Chemically synthesized
ccuguuacugauacuauaaguga

SEQ ID NO: 4524 - RNA, 23 nt, artificial
  Chemically synthesized
ggagauaugguuuauaguacagc

SEQ ID NO: 4525 - RNA, 23 nt, artificial
  Chemically synthesized
uggagauaugguuuauaguacag

SEQ ID NO: 4526 - RNA, 23 nt, artificial
  Chemically synthesized
auggagauaugguuuauaguaca

SEQ ID NO: 4527 - RNA, 23 nt, artificial
  Chemically synthesized
uauggagauaugguuuauaguac

SEQ ID NO: 4528 - RNA, 23 nt, artificial
  Chemically synthesized
cuauggagauaugguuuauagua

SEQ ID NO: 4529 - RNA, 23 nt, artificial
  Chemically synthesized
cauagaucccauuuuuguacaga

SEQ ID NO: 4530 - RNA, 23 nt, artificial
  Chemically synthesized
gcauagaucccauuuuuguacag

SEQ ID NO: 4531 - RNA, 23 nt, artificial
  Chemically synthesized
ugcauagaucccauuuuuguaca

SEQ ID NO: 4532 - RNA, 23 nt, artificial
  Chemically synthesized
cugcauagaucccauuuuuguac

SEQ ID NO: 4533 - RNA, 23 nt, artificial
  Chemically synthesized
ucugcauagaucccauuuuugua

SEQ ID NO: 4534 - RNA, 23 nt, artificial
  Chemically synthesized
gaauugaaugggauggaauaggu

SEQ ID NO: 4535 - RNA, 23 nt, artificial
  Chemically synthesized
agaauugaaugggauggaauagg

SEQ ID NO: 4536 - RNA, 23 nt, artificial
  Chemically synthesized
cagaauugaaugggauggaauag

SEQ ID NO: 4537 - RNA, 23 nt, artificial
  Chemically synthesized
acagaauugaaugggauggaaua

SEQ ID NO: 4538 - RNA, 23 nt, artificial
  Chemically synthesized
cugugaggauaggaaauuaguuc

SEQ ID NO: 4539 - RNA, 23 nt, artificial
  Chemically synthesized
ccugugaggauaggaaauuaguu

SEQ ID NO: 4540 - RNA, 23 nt, artificial
  Chemically synthesized
accugugaggauaggaaauuagu

SEQ ID NO: 4541 - RNA, 23 nt, artificial
  Chemically synthesized
uaccugugaggauaggaaauuag

SEQ ID NO: 4542 - RNA, 23 nt, artificial
  Chemically synthesized
auaccugugaggauaggaaauua

SEQ ID NO: 4543 - RNA, 23 nt, artificial
  Chemically synthesized
acccuagguaagaguaaaugaga

SEQ ID NO: 4544 - RNA, 23 nt, artificial
  Chemically synthesized
aacccuagguaagaguaaaugag

SEQ ID NO: 4545 - RNA, 23 nt, artificial
  Chemically synthesized
uaacccuagguaagaguaaauga

SEQ ID NO: 4546 - RNA, 23 nt, artificial
  Chemically synthesized
ucaaaugcuuggaaagauacuac

SEQ ID NO: 4547 - RNA, 23 nt, artificial
  Chemically synthesized
uucaaaugcuuggaaagauacua

SEQ ID NO: 4548 - RNA, 23 nt, artificial
  Chemically synthesized
cuucaaaugcuuggaaagauacu

SEQ ID NO: 4549 - RNA, 23 nt, artificial
  Chemically synthesized
ucuucaaaugcuuggaaagauac

SEQ ID NO: 4550 - RNA, 23 nt, artificial
  Chemically synthesized
cucuucaaaugcuuggaaagaua

SEQ ID NO: 4551 - RNA, 23 nt, artificial
  Chemically synthesized
ggagaagugauucaaaauagugu

SEQ ID NO: 4552 - RNA, 23 nt, artificial
  Chemically synthesized
uggagaagugauucaaaauagug

SEQ ID NO: 4553 - RNA, 23 nt, artificial
  Chemically synthesized
uuggagaagugauucaaaauagu

SEQ ID NO: 4554 - RNA, 23 nt, artificial
  Chemically synthesized
uuuggagaagugauucaaaauag

SEQ ID NO: 4555 - RNA, 23 nt, artificial
  Chemically synthesized
cuuuggagaagugauucaaaaua

SEQ ID NO: 4556 - RNA, 23 nt, artificial
  Chemically synthesized
cguggauaaggagcuuauucagg

SEQ ID NO: 4557 - RNA, 23 nt, artificial
  Chemically synthesized
ucguggauaaggagcuuauucag

SEQ ID NO: 4558 - RNA, 23 nt, artificial
  Chemically synthesized
gucguggauaaggagcuuauuca

SEQ ID NO: 4559 - RNA, 23 nt, artificial
  Chemically synthesized
ggucguggauaaggagcuuauuc

SEQ ID NO: 4560 - RNA, 23 nt, artificial
  Chemically synthesized
gggucguggauaaggagcuuauu

SEQ ID NO: 4561 - RNA, 23 nt, artificial
  Chemically synthesized
ccagauuugccuauuuugauuuu

SEQ ID NO: 4562 - RNA, 23 nt, artificial
  Chemically synthesized
accagauuugccuauuuugauuu

SEQ ID NO: 4563 - RNA, 23 nt, artificial
  Chemically synthesized
aaccagauuugccuauuuugauu

SEQ ID NO: 4564 - RNA, 23 nt, artificial
  Chemically synthesized
aaaccagauuugccuauuuugau

SEQ ID NO: 4565 - RNA, 23 nt, artificial
  Chemically synthesized
uaaaccagauuugccuauuuuga

SEQ ID NO: 4566 - RNA, 23 nt, artificial
  Chemically synthesized
ccuuuggagaagugauucaaaau

SEQ ID NO: 4567 - RNA, 23 nt, artificial
  Chemically synthesized
gccuuuggagaagugauucaaaa

SEQ ID NO: 4568 - RNA, 23 nt, artificial
  Chemically synthesized
uugaggaaucaacuugccagaau

SEQ ID NO: 4569 - RNA, 23 nt, artificial
  Chemically synthesized
uuugaggaaucaacuugccagaa

SEQ ID NO: 4570 - RNA, 23 nt, artificial
  Chemically synthesized
auuugaggaaucaacuugccaga

SEQ ID NO: 4571 - RNA, 23 nt, artificial
  Chemically synthesized
gagaaauauuacggcaauaaugg

SEQ ID NO: 4572 - RNA, 23 nt, artificial
  Chemically synthesized
ugagaaauauuacggcaauaaug

SEQ ID NO: 4573 - RNA, 23 nt, artificial
  Chemically synthesized
augagaaauauuacggcaauaau

SEQ ID NO: 4574 - RNA, 23 nt, artificial
  Chemically synthesized
aaugagaaauauuacggcaauaa

SEQ ID NO: 4575 - RNA, 23 nt, artificial
  Chemically synthesized
aaaugagaaauauuacggcaaua

SEQ ID NO: 4576 - RNA, 23 nt, artificial
  Chemically synthesized
uacagaauugaaugggauggaau

SEQ ID NO: 4577 - RNA, 23 nt, artificial
  Chemically synthesized
guacagaauugaaugggauggaa

SEQ ID NO: 4578 - RNA, 23 nt, artificial
  Chemically synthesized
auggaauagguaagcaaaaguag

SEQ ID NO: 4579 - RNA, 23 nt, artificial
  Chemically synthesized
guaaaaagcuggauaggauugug

SEQ ID NO: 4580 - RNA, 23 nt, artificial
  Chemically synthesized
uguaaaaagcuggauaggauugu

SEQ ID NO: 4581 - RNA, 23 nt, artificial
  Chemically synthesized
auguaaaaagcuggauaggauug

SEQ ID NO: 4582 - RNA, 23 nt, artificial
  Chemically synthesized
uauguaaaaagcuggauaggauu

SEQ ID NO: 4583 - RNA, 23 nt, artificial
  Chemically synthesized
guauguaaaaagcuggauaggau

SEQ ID NO: 4584 - RNA, 23 nt, artificial
  Chemically synthesized
ccaccaguuccugacucaaauuu

SEQ ID NO: 4585 - RNA, 23 nt, artificial
  Chemically synthesized
accaccaguuccugacucaaauu

SEQ ID NO: 4586 - RNA, 23 nt, artificial
  Chemically synthesized
caccaccaguuccugacucaaau

SEQ ID NO: 4587 - RNA, 23 nt, artificial
  Chemically synthesized
acaccaccaguuccugacucaaa

SEQ ID NO: 4588 - RNA, 23 nt, artificial
  Chemically synthesized
cacaccaccaguuccugacucaa

SEQ ID NO: 4589 - RNA, 23 nt, artificial
  Chemically synthesized
caaauuagccaguguucuaacaa

SEQ ID NO: 4590 - RNA, 23 nt, artificial
  Chemically synthesized
ucaaauuagccaguguucuaaca

SEQ ID NO: 4591 - RNA, 23 nt, artificial
  Chemically synthesized
uucaaauuagccaguguucuaac

SEQ ID NO: 4592 - RNA, 23 nt, artificial
  Chemically synthesized
guucaaauuagccaguguucuaa

SEQ ID NO: 4593 - RNA, 23 nt, artificial
  Chemically synthesized
uguucaaauuagccaguguucua

SEQ ID NO: 4594 - RNA, 23 nt, artificial
  Chemically synthesized
caccugcccuaaauaagaaaccc

SEQ ID NO: 4595 - RNA, 23 nt, artificial
  Chemically synthesized
cucacugauuggaacaacaguga

SEQ ID NO: 4596 - RNA, 23 nt, artificial
  Chemically synthesized
acucacugauuggaacaacagug

SEQ ID NO: 4597 - RNA, 23 nt, artificial
  Chemically synthesized
uacucacugauuggaacaacagu

SEQ ID NO: 4598 - RNA, 23 nt, artificial
  Chemically synthesized
uuacucacugauuggaacaacag

SEQ ID NO: 4599 - RNA, 23 nt, artificial
  Chemically synthesized
uuuacucacugauuggaacaaca

SEQ ID NO: 4600 - RNA, 23 nt, artificial
  Chemically synthesized
augcuggagaacugucuguccaa

SEQ ID NO: 4601 - RNA, 23 nt, artificial
  Chemically synthesized
uuuauagaauugggccaagauaa

SEQ ID NO: 4602 - RNA, 23 nt, artificial
  Chemically synthesized
acucuucaaaugcuuggaaagau

SEQ ID NO: 4603 - RNA, 23 nt, artificial
  Chemically synthesized
aacucuucaaaugcuuggaaaga

SEQ ID NO: 4604 - RNA, 23 nt, artificial
  Chemically synthesized
aaacucuucaaaugcuuggaaag

SEQ ID NO: 4605 - RNA, 23 nt, artificial
  Chemically synthesized
uaaacucuucaaaugcuuggaaa

SEQ ID NO: 4606 - RNA, 23 nt, artificial
  Chemically synthesized
ucuuggugacuuccucacucuaa

SEQ ID NO: 4607 - RNA, 23 nt, artificial
  Chemically synthesized
gagaacugcucauggacuagcuu

SEQ ID NO: 4608 - RNA, 23 nt, artificial
  Chemically synthesized
ggagaacugcucauggacuagcu

SEQ ID NO: 4609 - RNA, 23 nt, artificial
  Chemically synthesized
aggagaacugcucauggacuagc

SEQ ID NO: 4610 - RNA, 23 nt, artificial
  Chemically synthesized
caggagaacugcucauggacuag

SEQ ID NO: 4611 - RNA, 23 nt, artificial
  Chemically synthesized
gcaggagaacugcucauggacua

SEQ ID NO: 4612 - RNA, 23 nt, artificial
  Chemically synthesized
ugugggucguggauaaggagcuu

SEQ ID NO: 4613 - RNA, 23 nt, artificial
  Chemically synthesized
cugugggucguggauaaggagcu

SEQ ID NO: 4614 - RNA, 23 nt, artificial
  Chemically synthesized
gcugugggucguggauaaggagc

SEQ ID NO: 4615 - RNA, 23 nt, artificial
  Chemically synthesized
gugaccuaaaaugucacuguuca

SEQ ID NO: 4616 - RNA, 23 nt, artificial
  Chemically synthesized
gagaaacugacccagagaauugc

SEQ ID NO: 4617 - RNA, 23 nt, artificial
  Chemically synthesized
ugagaaacugacccagagaauug

SEQ ID NO: 4618 - RNA, 23 nt, artificial
  Chemically synthesized
cugagaaacugacccagagaauu

SEQ ID NO: 4619 - RNA, 23 nt, artificial
  Chemically synthesized
ccugagaaacugacccagagaau

SEQ ID NO: 4620 - RNA, 23 nt, artificial
  Chemically synthesized
cccugagaaacugacccagagaa

SEQ ID NO: 4621 - RNA, 23 nt, artificial
  Chemically synthesized
caccaguuccugacucaaauuug

SEQ ID NO: 4622 - RNA, 23 nt, artificial
  Chemically synthesized
ucaaagguccuugucccugagaa

SEQ ID NO: 4623 - RNA, 23 nt, artificial
  Chemically synthesized
cucaaagguccuugucccugaga

SEQ ID NO: 4624 - RNA, 23 nt, artificial
  Chemically synthesized
gcucaaagguccuugucccugag

SEQ ID NO: 4625 - RNA, 23 nt, artificial
  Chemically synthesized
ugcucaaagguccuugucccuga

SEQ ID NO: 4626 - RNA, 23 nt, artificial
  Chemically synthesized
gauuucgacuuguuaagaaaaaa

SEQ ID NO: 4627 - RNA, 23 nt, artificial
  Chemically synthesized
ggauuucgacuuguuaagaaaaa

SEQ ID NO: 4628 - RNA, 23 nt, artificial
  Chemically synthesized
aggauuucgacuuguuaagaaaa

SEQ ID NO: 4629 - RNA, 23 nt, artificial
  Chemically synthesized
ugagugaaugaugaauaccugug

SEQ ID NO: 4630 - RNA, 23 nt, artificial
  Chemically synthesized
uugagugaaugaugaauaccugu

SEQ ID NO: 4631 - RNA, 23 nt, artificial
  Chemically synthesized
auugagugaaugaugaauaccug

SEQ ID NO: 4632 - RNA, 23 nt, artificial
  Chemically synthesized
cauugagugaaugaugaauaccu

SEQ ID NO: 4633 - RNA, 23 nt, artificial
  Chemically synthesized
caauaauggaacugcuucacugu

SEQ ID NO: 4634 - RNA, 23 nt, artificial
  Chemically synthesized
gcaauaauggaacugcuucacug

SEQ ID NO: 4635 - RNA, 23 nt, artificial
  Chemically synthesized
ggcaauaauggaacugcuucacu

SEQ ID NO: 4636 - RNA, 23 nt, artificial
  Chemically synthesized
cggcaauaauggaacugcuucac

SEQ ID NO: 4637 - RNA, 23 nt, artificial
  Chemically synthesized
acggcaauaauggaacugcuuca

SEQ ID NO: 4638 - RNA, 23 nt, artificial
  Chemically synthesized
cacuaacaguuaucuuugacucu

SEQ ID NO: 4639 - RNA, 23 nt, artificial
  Chemically synthesized
ccacuaacaguuaucuuugacuc

SEQ ID NO: 4640 - RNA, 23 nt, artificial
  Chemically synthesized
uccacuaacaguuaucuuugacu

SEQ ID NO: 4641 - RNA, 23 nt, artificial
  Chemically synthesized
uuccacuaacaguuaucuuugac

SEQ ID NO: 4642 - RNA, 23 nt, artificial
  Chemically synthesized
uuuccacuaacaguuaucuuuga

SEQ ID NO: 4643 - RNA, 23 nt, artificial
  Chemically synthesized
gcgucguaccuacuuuugagcuu

SEQ ID NO: 4644 - RNA, 23 nt, artificial
  Chemically synthesized
agcgucguaccuacuuuugagcu

SEQ ID NO: 4645 - RNA, 23 nt, artificial
  Chemically synthesized
uagcgucguaccuacuuuugagc

SEQ ID NO: 4646 - RNA, 23 nt, artificial
  Chemically synthesized
cuagcgucguaccuacuuuugag

SEQ ID NO: 4647 - RNA, 23 nt, artificial
  Chemically synthesized
ucuagcgucguaccuacuuuuga

SEQ ID NO: 4648 - RNA, 23 nt, artificial
  Chemically synthesized
cggccagcauuucagaauugcug

SEQ ID NO: 4649 - RNA, 23 nt, artificial
  Chemically synthesized
ccggccagcauuucagaauugcu

SEQ ID NO: 4650 - RNA, 23 nt, artificial
  Chemically synthesized
cccggccagcauuucagaauugc

SEQ ID NO: 4651 - RNA, 23 nt, artificial
  Chemically synthesized
acccggccagcauuucagaauug

SEQ ID NO: 4652 - RNA, 23 nt, artificial
  Chemically synthesized
aacccggccagcauuucagaauu

SEQ ID NO: 4653 - RNA, 23 nt, artificial
  Chemically synthesized
gugcuuaaucucagaugaaccau

SEQ ID NO: 4654 - RNA, 23 nt, artificial
  Chemically synthesized
ugugcuuaaucucagaugaacca

SEQ ID NO: 4655 - RNA, 23 nt, artificial
  Chemically synthesized
augugcuuaaucucagaugaacc

SEQ ID NO: 4656 - RNA, 23 nt, artificial
  Chemically synthesized
caugugcuuaaucucagaugaac

SEQ ID NO: 4657 - RNA, 23 nt, artificial
  Chemically synthesized
gaauagguaagcaaaaguagaag

SEQ ID NO: 4658 - RNA, 23 nt, artificial
  Chemically synthesized
ggaauagguaagcaaaaguagaa

SEQ ID NO: 4659 - RNA, 23 nt, artificial
  Chemically synthesized
uggaauagguaagcaaaaguaga

SEQ ID NO: 4660 - RNA, 23 nt, artificial
  Chemically synthesized
guuguguuaugcacgugaacuug

SEQ ID NO: 4661 - RNA, 23 nt, artificial
  Chemically synthesized
gguuguguuaugcacgugaacuu

SEQ ID NO: 4662 - RNA, 23 nt, artificial
  Chemically synthesized
agguuguguuaugcacgugaacu

SEQ ID NO: 4663 - RNA, 23 nt, artificial
  Chemically synthesized
gagguuguguuaugcacgugaac

SEQ ID NO: 4664 - RNA, 23 nt, artificial
  Chemically synthesized
cgagguuguguuaugcacgugaa

SEQ ID NO: 4665 - RNA, 23 nt, artificial
  Chemically synthesized
aguacagccuagagaaugaaacu

SEQ ID NO: 4666 - RNA, 23 nt, artificial
  Chemically synthesized
uaguacagccuagagaaugaaac

SEQ ID NO: 4667 - RNA, 23 nt, artificial
  Chemically synthesized
auaguacagccuagagaaugaaa

SEQ ID NO: 4668 - RNA, 23 nt, artificial
  Chemically synthesized
uauaguacagccuagagaaugaa

SEQ ID NO: 4669 - RNA, 23 nt, artificial
  Chemically synthesized
uuauaguacagccuagagaauga

SEQ ID NO: 4670 - RNA, 23 nt, artificial
  Chemically synthesized
acugucuguccaaaucaaagcaa

SEQ ID NO: 4671 - RNA, 23 nt, artificial
  Chemically synthesized
agcuuacacuuguguuuaagcag

SEQ ID NO: 4672 - RNA, 23 nt, artificial
  Chemically synthesized
gagcuuacacuuguguuuaagca

SEQ ID NO: 4673 - RNA, 23 nt, artificial
  Chemically synthesized
ugagcuuacacuuguguuuaagc

SEQ ID NO: 4674 - RNA, 23 nt, artificial
  Chemically synthesized
uugagcuuacacuuguguuuaag

SEQ ID NO: 4675 - RNA, 23 nt, artificial
  Chemically synthesized
uuugagcuuacacuuguguuuaa

SEQ ID NO: 4676 - RNA, 23 nt, artificial
  Chemically synthesized
gauuggguaguaaaacuauucag

SEQ ID NO: 4677 - RNA, 23 nt, artificial
  Chemically synthesized
ugauuggguaguaaaacuauuca

SEQ ID NO: 4678 - RNA, 23 nt, artificial
  Chemically synthesized
augauuggguaguaaaacuauuc

SEQ ID NO: 4679 - RNA, 23 nt, artificial
  Chemically synthesized
caugauuggguaguaaaacuauu

SEQ ID NO: 4680 - RNA, 23 nt, artificial
  Chemically synthesized
gugaacuuggaaauugaaaaugu

SEQ ID NO: 4681 - RNA, 23 nt, artificial
  Chemically synthesized
gccagaauuugguuaaaaugcug

SEQ ID NO: 4682 - RNA, 23 nt, artificial
  Chemically synthesized
ugccagaauuugguuaaaaugcu

SEQ ID NO: 4683 - RNA, 23 nt, artificial
  Chemically synthesized
uugccagaauuugguuaaaaugc

SEQ ID NO: 4684 - RNA, 23 nt, artificial
  Chemically synthesized
cuugccagaauuugguuaaaaug

SEQ ID NO: 4685 - RNA, 23 nt, artificial
  Chemically synthesized
acuugccagaauuugguuaaaau

SEQ ID NO: 4686 - RNA, 23 nt, artificial
  Chemically synthesized
aacuggcaguuugagcagcaaga

SEQ ID NO: 4687 - RNA, 23 nt, artificial
  Chemically synthesized
caacuggcaguuugagcagcaag

SEQ ID NO: 4688 - RNA, 23 nt, artificial
  Chemically synthesized
gcaacuggcaguuugagcagcaa

SEQ ID NO: 4689 - RNA, 23 nt, artificial
  Chemically synthesized
gucacuagggaauaauaaaggcc

SEQ ID NO: 4690 - RNA, 23 nt, artificial
  Chemically synthesized
ugucacuagggaauaauaaaggc

SEQ ID NO: 4691 - RNA, 23 nt, artificial
  Chemically synthesized
agaucuagucccucucugauuca

SEQ ID NO: 4692 - RNA, 23 nt, artificial
  Chemically synthesized
gagaucuagucccucucugauuc

SEQ ID NO: 4693 - RNA, 23 nt, artificial
  Chemically synthesized
ugagaucuagucccucucugauu

SEQ ID NO: 4694 - RNA, 23 nt, artificial
  Chemically synthesized
cugagaucuagucccucucugau

SEQ ID NO: 4695 - RNA, 23 nt, artificial
  Chemically synthesized
ucugagaucuagucccucucuga

SEQ ID NO: 4696 - RNA, 23 nt, artificial
  Chemically synthesized
ggcuucuugggcaucgauguaga

SEQ ID NO: 4697 - RNA, 23 nt, artificial
  Chemically synthesized
ccagagaauugcucaagaugucc

SEQ ID NO: 4698 - RNA, 23 nt, artificial
  Chemically synthesized
cccagagaauugcucaagauguc

SEQ ID NO: 4699 - RNA, 23 nt, artificial
  Chemically synthesized
acccagagaauugcucaagaugu

SEQ ID NO: 4700 - RNA, 23 nt, artificial
  Chemically synthesized
gacccagagaauugcucaagaug

SEQ ID NO: 4701 - RNA, 23 nt, artificial
  Chemically synthesized
ugacccagagaauugcucaagau

SEQ ID NO: 4702 - RNA, 23 nt, artificial
  Chemically synthesized
cccuguucuuaaguguugaauac

SEQ ID NO: 4703 - RNA, 23 nt, artificial
  Chemically synthesized
ccccuguucuuaaguguugaaua

SEQ ID NO: 4704 - RNA, 23 nt, artificial
  Chemically synthesized
uccccuguucuuaaguguugaau

SEQ ID NO: 4705 - RNA, 23 nt, artificial
  Chemically synthesized
uuccccuguucuuaaguguugaa

SEQ ID NO: 4706 - RNA, 23 nt, artificial
  Chemically synthesized
uuuccccuguucuuaaguguuga

SEQ ID NO: 4707 - RNA, 23 nt, artificial
  Chemically synthesized
cugacccagagaauugcucaaga

SEQ ID NO: 4708 - RNA, 23 nt, artificial
  Chemically synthesized
acugacccagagaauugcucaag

SEQ ID NO: 4709 - RNA, 23 nt, artificial
  Chemically synthesized
aacugacccagagaauugcucaa

SEQ ID NO: 4710 - RNA, 23 nt, artificial
  Chemically synthesized
ggccuuuggagaagugauucaaa

SEQ ID NO: 4711 - RNA, 23 nt, artificial
  Chemically synthesized
ccauggcaguguuaucucaucuc

SEQ ID NO: 4712 - RNA, 23 nt, artificial
  Chemically synthesized
accauggcaguguuaucucaucu

SEQ ID NO: 4713 - RNA, 23 nt, artificial
  Chemically synthesized
caccauggcaguguuaucucauc

SEQ ID NO: 4714 - RNA, 23 nt, artificial
  Chemically synthesized
ucaccauggcaguguuaucucau

SEQ ID NO: 4715 - RNA, 23 nt, artificial
  Chemically synthesized
uucaccauggcaguguuaucuca

SEQ ID NO: 4716 - RNA, 23 nt, artificial
  Chemically synthesized
cagcucaggauuucgacuuguua

SEQ ID NO: 4717 - RNA, 23 nt, artificial
  Chemically synthesized
gacaggaagguaggauuaaguag

SEQ ID NO: 4718 - RNA, 23 nt, artificial
  Chemically synthesized
agacaggaagguaggauuaagua

SEQ ID NO: 4719 - RNA, 23 nt, artificial
  Chemically synthesized
uagacaggaagguaggauuaagu

SEQ ID NO: 4720 - RNA, 23 nt, artificial
  Chemically synthesized
uuagacaggaagguaggauuaag

SEQ ID NO: 4721 - RNA, 23 nt, artificial
  Chemically synthesized
uuuagacaggaagguaggauuaa

SEQ ID NO: 4722 - RNA, 23 nt, artificial
  Chemically synthesized
ggguccuaaaaagggaaaauaua

SEQ ID NO: 4723 - RNA, 23 nt, artificial
  Chemically synthesized
aggguccuaaaaagggaaaauau

SEQ ID NO: 4724 - RNA, 23 nt, artificial
  Chemically synthesized
aaggguccuaaaaagggaaaaua

SEQ ID NO: 4725 - RNA, 23 nt, artificial
  Chemically synthesized
ggauaaggagcuuauucagguuu

SEQ ID NO: 4726 - RNA, 23 nt, artificial
  Chemically synthesized
uggauaaggagcuuauucagguu

SEQ ID NO: 4727 - RNA, 23 nt, artificial
  Chemically synthesized
guggauaaggagcuuauucaggu

SEQ ID NO: 4728 - RNA, 23 nt, artificial
  Chemically synthesized
cuuauggaaggcuguuaaauuaa

SEQ ID NO: 4729 - RNA, 23 nt, artificial
  Chemically synthesized
cgaaggaaacagagccguugacc

SEQ ID NO: 4730 - RNA, 23 nt, artificial
  Chemically synthesized
gcgaaggaaacagagccguugac

SEQ ID NO: 4731 - RNA, 23 nt, artificial
  Chemically synthesized
cgcgaaggaaacagagccguuga

SEQ ID NO: 4732 - RNA, 23 nt, artificial
  Chemically synthesized
ucgcgaaggaaacagagccguug

SEQ ID NO: 4733 - RNA, 23 nt, artificial
  Chemically synthesized
cucgcgaaggaaacagagccguu

SEQ ID NO: 4734 - RNA, 23 nt, artificial
  Chemically synthesized
guucuaacaaacuaaacucuuca

SEQ ID NO: 4735 - RNA, 23 nt, artificial
  Chemically synthesized
uguucuaacaaacuaaacucuuc

SEQ ID NO: 4736 - RNA, 23 nt, artificial
  Chemically synthesized
ccuguucuuaaguguugaauacu

SEQ ID NO: 4737 - RNA, 23 nt, artificial
  Chemically synthesized
ggccuuauuuuuugucuuauucc

SEQ ID NO: 4738 - RNA, 23 nt, artificial
  Chemically synthesized
aggccuuauuuuuugucuuauuc

SEQ ID NO: 4739 - RNA, 23 nt, artificial
  Chemically synthesized
aaggccuuauuuuuugucuuauu

SEQ ID NO: 4740 - RNA, 23 nt, artificial
  Chemically synthesized
aaaggccuuauuuuuugucuuau

SEQ ID NO: 4741 - RNA, 23 nt, artificial
  Chemically synthesized
uaaaggccuuauuuuuugucuua

SEQ ID NO: 4742 - RNA, 23 nt, artificial
  Chemically synthesized
cucucugauucacuuaguaaucu

SEQ ID NO: 4743 - RNA, 23 nt, artificial
  Chemically synthesized
ccucucugauucacuuaguaauc

SEQ ID NO: 4744 - RNA, 23 nt, artificial
  Chemically synthesized
cccucucugauucacuuaguaau

SEQ ID NO: 4745 - RNA, 23 nt, artificial
  Chemically synthesized
ucccucucugauucacuuaguaa

SEQ ID NO: 4746 - RNA, 23 nt, artificial
  Chemically synthesized
gucccucucugauucacuuagua

SEQ ID NO: 4747 - RNA, 23 nt, artificial
  Chemically synthesized
gcaucgauguagaacuguugucc

SEQ ID NO: 4748 - RNA, 23 nt, artificial
  Chemically synthesized
ggcaucgauguagaacuguuguc

SEQ ID NO: 4749 - RNA, 23 nt, artificial
  Chemically synthesized
gggcaucgauguagaacuguugu

SEQ ID NO: 4750 - RNA, 23 nt, artificial
  Chemically synthesized
ugggcaucgauguagaacuguug

SEQ ID NO: 4751 - RNA, 23 nt, artificial
  Chemically synthesized
uugggcaucgauguagaacuguu

SEQ ID NO: 4752 - RNA, 23 nt, artificial
  Chemically synthesized
cgucguaccuacuuuugagcuua

SEQ ID NO: 4753 - RNA, 23 nt, artificial
  Chemically synthesized
gaaugaaacucaccguccagaua

SEQ ID NO: 4754 - RNA, 23 nt, artificial
  Chemically synthesized
agaaugaaacucaccguccagau

SEQ ID NO: 4755 - RNA, 23 nt, artificial
  Chemically synthesized
gagaaugaaacucaccguccaga

SEQ ID NO: 4756 - RNA, 23 nt, artificial
  Chemically synthesized
agagaaugaaacucaccguccag

SEQ ID NO: 4757 - RNA, 23 nt, artificial
  Chemically synthesized
uagagaaugaaacucaccgucca

SEQ ID NO: 4758 - RNA, 23 nt, artificial
  Chemically synthesized
gucuauuguuaagcuccaaaggu

SEQ ID NO: 4759 - RNA, 23 nt, artificial
  Chemically synthesized
ugucuauuguuaagcuccaaagg

SEQ ID NO: 4760 - RNA, 23 nt, artificial
  Chemically synthesized
augucuauuguuaagcuccaaag

SEQ ID NO: 4761 - RNA, 23 nt, artificial
  Chemically synthesized
caugucuauuguuaagcuccaaa

SEQ ID NO: 4762 - RNA, 23 nt, artificial
  Chemically synthesized
gcaugucuauuguuaagcuccaa

SEQ ID NO: 4763 - RNA, 23 nt, artificial
  Chemically synthesized
caaccucaacgagguaauauuug

SEQ ID NO: 4764 - RNA, 23 nt, artificial
  Chemically synthesized
ccaaccucaacgagguaauauuu

SEQ ID NO: 4765 - RNA, 23 nt, artificial
  Chemically synthesized
cccaaccucaacgagguaauauu

SEQ ID NO: 4766 - RNA, 23 nt, artificial
  Chemically synthesized
acccaaccucaacgagguaauau

SEQ ID NO: 4767 - RNA, 23 nt, artificial
  Chemically synthesized
aacccaaccucaacgagguaaua

SEQ ID NO: 4768 - RNA, 23 nt, artificial
  Chemically synthesized
gggccaagauaaaucaauguugu

SEQ ID NO: 4769 - RNA, 23 nt, artificial
  Chemically synthesized
ugggccaagauaaaucaauguug

SEQ ID NO: 4770 - RNA, 23 nt, artificial
  Chemically synthesized
uugggccaagauaaaucaauguu

SEQ ID NO: 4771 - RNA, 23 nt, artificial
  Chemically synthesized
auugggccaagauaaaucaaugu

SEQ ID NO: 4772 - RNA, 23 nt, artificial
  Chemically synthesized
aauugggccaagauaaaucaaug

SEQ ID NO: 4773 - RNA, 23 nt, artificial
  Chemically synthesized
gguaggcuugguaauagacuaua

SEQ ID NO: 4774 - RNA, 23 nt, artificial
  Chemically synthesized
gguaauauuugaggaaucaacuu

SEQ ID NO: 4775 - RNA, 23 nt, artificial
  Chemically synthesized
agguaauauuugaggaaucaacu

SEQ ID NO: 4776 - RNA, 23 nt, artificial
  Chemically synthesized
gagguaauauuugaggaaucaac

SEQ ID NO: 4777 - RNA, 23 nt, artificial
  Chemically synthesized
uguauguaaaaagcuggauagga

SEQ ID NO: 4778 - RNA, 23 nt, artificial
  Chemically synthesized
auguauguaaaaagcuggauagg

SEQ ID NO: 4779 - RNA, 23 nt, artificial
  Chemically synthesized
aauguauguaaaaagcuggauag

SEQ ID NO: 4780 - RNA, 23 nt, artificial
  Chemically synthesized
aaauguauguaaaaagcuggaua

SEQ ID NO: 4781 - RNA, 23 nt, artificial
  Chemically synthesized
gaaacgggucaauuuacgaaguc

SEQ ID NO: 4782 - RNA, 23 nt, artificial
  Chemically synthesized
ugaaacgggucaauuuacgaagu

SEQ ID NO: 4783 - RNA, 23 nt, artificial
  Chemically synthesized
uugaaacgggucaauuuacgaag

SEQ ID NO: 4784 - RNA, 23 nt, artificial
  Chemically synthesized
auugaaacgggucaauuuacgaa

SEQ ID NO: 4785 - RNA, 23 nt, artificial
  Chemically synthesized
uauugaaacgggucaauuuacga

SEQ ID NO: 4786 - RNA, 23 nt, artificial
  Chemically synthesized
guugcaacuggcaguuugagcag

SEQ ID NO: 4787 - RNA, 23 nt, artificial
  Chemically synthesized
gguugcaacuggcaguuugagca

SEQ ID NO: 4788 - RNA, 23 nt, artificial
  Chemically synthesized
ugguugcaacuggcaguuugagc

SEQ ID NO: 4789 - RNA, 23 nt, artificial
  Chemically synthesized
augguugcaacuggcaguuugag

SEQ ID NO: 4790 - RNA, 23 nt, artificial
  Chemically synthesized
caugguugcaacuggcaguuuga

SEQ ID NO: 4791 - RNA, 23 nt, artificial
  Chemically synthesized
ccuagagaaugaaacucaccguc

SEQ ID NO: 4792 - RNA, 23 nt, artificial
  Chemically synthesized
gccuagagaaugaaacucaccgu

SEQ ID NO: 4793 - RNA, 23 nt, artificial
  Chemically synthesized
agccuagagaaugaaacucaccg

SEQ ID NO: 4794 - RNA, 23 nt, artificial
  Chemically synthesized
cagccuagagaaugaaacucacc

SEQ ID NO: 4795 - RNA, 23 nt, artificial
  Chemically synthesized
acagccuagagaaugaaacucac

SEQ ID NO: 4796 - RNA, 23 nt, artificial
  Chemically synthesized
gccugcuaagugauuuugacuac

SEQ ID NO: 4797 - RNA, 23 nt, artificial
  Chemically synthesized
agccugcuaagugauuuugacua

SEQ ID NO: 4798 - RNA, 23 nt, artificial
  Chemically synthesized
gagccugcuaagugauuuugacu

SEQ ID NO: 4799 - RNA, 23 nt, artificial
  Chemically synthesized
agagccugcuaagugauuuugac

SEQ ID NO: 4800 - RNA, 23 nt, artificial
  Chemically synthesized
gagagccugcuaagugauuuuga

SEQ ID NO: 4801 - RNA, 23 nt, artificial
  Chemically synthesized
cuauuagcuccacuucacaugcu

SEQ ID NO: 4802 - RNA, 23 nt, artificial
  Chemically synthesized
gcuauuagcuccacuucacaugc

SEQ ID NO: 4803 - RNA, 23 nt, artificial
  Chemically synthesized
agcuauuagcuccacuucacaug

SEQ ID NO: 4804 - RNA, 23 nt, artificial
  Chemically synthesized
uagcuauuagcuccacuucacau

SEQ ID NO: 4805 - RNA, 23 nt, artificial
  Chemically synthesized
cuagcuauuagcuccacuucaca

SEQ ID NO: 4806 - RNA, 23 nt, artificial
  Chemically synthesized
caacagugauugaaggguccuaa

SEQ ID NO: 4807 - RNA, 23 nt, artificial
  Chemically synthesized
ggguaguagcuguauacuaccac

SEQ ID NO: 4808 - RNA, 23 nt, artificial
  Chemically synthesized
aggguaguagcuguauacuacca

SEQ ID NO: 4809 - RNA, 23 nt, artificial
  Chemically synthesized
aaggguaguagcuguauacuacc

SEQ ID NO: 4810 - RNA, 23 nt, artificial
  Chemically synthesized
ggauuaaguaggugaguuuaauu

SEQ ID NO: 4811 - RNA, 23 nt, artificial
  Chemically synthesized
aggauuaaguaggugaguuuaau

SEQ ID NO: 4812 - RNA, 23 nt, artificial
  Chemically synthesized
uaggauuaaguaggugaguuuaa

SEQ ID NO: 4813 - RNA, 23 nt, artificial
  Chemically synthesized
guaggauuaaguaggugaguuua

SEQ ID NO: 4814 - RNA, 23 nt, artificial
  Chemically synthesized
gguaggauuaaguaggugaguuu

SEQ ID NO: 4815 - RNA, 23 nt, artificial
  Chemically synthesized
uguuguuuugcaugucuauuguu

SEQ ID NO: 4816 - RNA, 23 nt, artificial
  Chemically synthesized
auguuguuuugcaugucuauugu

SEQ ID NO: 4817 - RNA, 23 nt, artificial
  Chemically synthesized
aauguuguuuugcaugucuauug

SEQ ID NO: 4818 - RNA, 23 nt, artificial
  Chemically synthesized
caauguuguuuugcaugucuauu

SEQ ID NO: 4819 - RNA, 23 nt, artificial
  Chemically synthesized
ucaauguuguuuugcaugucuau

SEQ ID NO: 4820 - RNA, 23 nt, artificial
  Chemically synthesized
guuccugacucaaauuugaaggg

SEQ ID NO: 4821 - RNA, 23 nt, artificial
  Chemically synthesized
aguuccugacucaaauuugaagg

SEQ ID NO: 4822 - RNA, 23 nt, artificial
  Chemically synthesized
caguuccugacucaaauuugaag

SEQ ID NO: 4823 - RNA, 23 nt, artificial
  Chemically synthesized
ccaguuccugacucaaauuugaa

SEQ ID NO: 4824 - RNA, 23 nt, artificial
  Chemically synthesized
accaguuccugacucaaauuuga

SEQ ID NO: 4825 - RNA, 23 nt, artificial
  Chemically synthesized
aguaaccacgguguuguuuuaga

SEQ ID NO: 4826 - RNA, 23 nt, artificial
  Chemically synthesized
caguaaccacgguguuguuuuag

SEQ ID NO: 4827 - RNA, 23 nt, artificial
  Chemically synthesized
ucaguaaccacgguguuguuuua

SEQ ID NO: 4828 - RNA, 23 nt, artificial
  Chemically synthesized
uucaguaaccacgguguuguuuu

SEQ ID NO: 4829 - RNA, 23 nt, artificial
  Chemically synthesized
uuucaguaaccacgguguuguuu

SEQ ID NO: 4830 - RNA, 23 nt, artificial
  Chemically synthesized
auuucaguaaccacgguguuguu

SEQ ID NO: 4831 - RNA, 23 nt, artificial
  Chemically synthesized
agauuuuuuccaccuuggauacc

SEQ ID NO: 4832 - RNA, 23 nt, artificial
  Chemically synthesized
cagauuuuuuccaccuuggauac

SEQ ID NO: 4833 - RNA, 23 nt, artificial
  Chemically synthesized
ccagauuuuuuccaccuuggaua

SEQ ID NO: 4834 - RNA, 23 nt, artificial
  Chemically synthesized
cccagauuuuuuccaccuuggau

SEQ ID NO: 4835 - RNA, 23 nt, artificial
  Chemically synthesized
acccagauuuuuuccaccuugga

SEQ ID NO: 4836 - RNA, 23 nt, artificial
  Chemically synthesized
cagauuugccuauuuugauuuuc

SEQ ID NO: 4837 - RNA, 23 nt, artificial
  Chemically synthesized
uuuauaguacagccuagagaaug

SEQ ID NO: 4838 - RNA, 23 nt, artificial
  Chemically synthesized
guuuauaguacagccuagagaau

SEQ ID NO: 4839 - RNA, 23 nt, artificial
  Chemically synthesized
gguuuauaguacagccuagagaa

SEQ ID NO: 4840 - RNA, 23 nt, artificial
  Chemically synthesized
gcgagguuguguuaugcacguga

SEQ ID NO: 4841 - RNA, 23 nt, artificial
  Chemically synthesized
gauaccugucacuagggaauaau

SEQ ID NO: 4842 - RNA, 23 nt, artificial
  Chemically synthesized
ggauaccugucacuagggaauaa

SEQ ID NO: 4843 - RNA, 23 nt, artificial
  Chemically synthesized
uggauaccugucacuagggaaua

SEQ ID NO: 4844 - RNA, 23 nt, artificial
  Chemically synthesized
uuggauaccugucacuagggaau

SEQ ID NO: 4845 - RNA, 23 nt, artificial
  Chemically synthesized
cuuggauaccugucacuagggaa

SEQ ID NO: 4846 - RNA, 23 nt, artificial
  Chemically synthesized
uaaaugagaaauauuacggcaau

SEQ ID NO: 4847 - RNA, 23 nt, artificial
  Chemically synthesized
ccuaucaaaacuuccaaaagccc

SEQ ID NO: 4848 - RNA, 23 nt, artificial
  Chemically synthesized
gcguagggacagauguauucauc

SEQ ID NO: 4849 - RNA, 23 nt, artificial
  Chemically synthesized
ggcguagggacagauguauucau

SEQ ID NO: 4850 - RNA, 23 nt, artificial
  Chemically synthesized
cggcguagggacagauguauuca

SEQ ID NO: 4851 - RNA, 23 nt, artificial
  Chemically synthesized
ccggcguagggacagauguauuc

SEQ ID NO: 4852 - RNA, 23 nt, artificial
  Chemically synthesized
accggcguagggacagauguauu

SEQ ID NO: 4853 - RNA, 23 nt, artificial
  Chemically synthesized
gauacuauaagugaccuaaaaug

SEQ ID NO: 4854 - RNA, 23 nt, artificial
  Chemically synthesized
ugauacuauaagugaccuaaaau

SEQ ID NO: 4855 - RNA, 23 nt, artificial
  Chemically synthesized
cugauacuauaagugaccuaaaa

SEQ ID NO: 4856 - RNA, 23 nt, artificial
  Chemically synthesized
acugauacuauaagugaccuaaa

SEQ ID NO: 4857 - RNA, 23 nt, artificial
  Chemically synthesized
uacugauacuauaagugaccuaa

SEQ ID NO: 4858 - RNA, 23 nt, artificial
  Chemically synthesized
cgaagucugcauuggcuauggag

SEQ ID NO: 4859 - RNA, 23 nt, artificial
  Chemically synthesized
acgaagucugcauuggcuaugga

SEQ ID NO: 4860 - RNA, 23 nt, artificial
  Chemically synthesized
uacgaagucugcauuggcuaugg

SEQ ID NO: 4861 - RNA, 23 nt, artificial
  Chemically synthesized
uuacgaagucugcauuggcuaug

SEQ ID NO: 4862 - RNA, 23 nt, artificial
  Chemically synthesized
uuuacgaagucugcauuggcuau

SEQ ID NO: 4863 - RNA, 23 nt, artificial
  Chemically synthesized
ggauaggauugugugugauucua

SEQ ID NO: 4864 - RNA, 23 nt, artificial
  Chemically synthesized
uggauaggauugugugugauucu

SEQ ID NO: 4865 - RNA, 23 nt, artificial
  Chemically synthesized
cuggauaggauugugugugauuc

SEQ ID NO: 4866 - RNA, 23 nt, artificial
  Chemically synthesized
gcuggauaggauugugugugauu

SEQ ID NO: 4867 - RNA, 23 nt, artificial
  Chemically synthesized
agcuggauaggauugugugugau

SEQ ID NO: 4868 - RNA, 23 nt, artificial
  Chemically synthesized
uggccuuuggagaagugauucaa

SEQ ID NO: 4869 - RNA, 23 nt, artificial
  Chemically synthesized
cuggccuuuggagaagugauuca

SEQ ID NO: 4870 - RNA, 23 nt, artificial
  Chemically synthesized
ucuggccuuuggagaagugauuc

SEQ ID NO: 4871 - RNA, 23 nt, artificial
  Chemically synthesized
uucuggccuuuggagaagugauu

SEQ ID NO: 4872 - RNA, 23 nt, artificial
  Chemically synthesized
auagguaagcaaaaguagaagcc

SEQ ID NO: 4873 - RNA, 23 nt, artificial
  Chemically synthesized
aauagguaagcaaaaguagaagc

SEQ ID NO: 4874 - RNA, 23 nt, artificial
  Chemically synthesized
agguaggauuaaguaggugaguu

SEQ ID NO: 4875 - RNA, 23 nt, artificial
  Chemically synthesized
aagguaggauuaaguaggugagu

SEQ ID NO: 4876 - RNA, 23 nt, artificial
  Chemically synthesized
gaagguaggauuaaguaggugag

SEQ ID NO: 4877 - RNA, 23 nt, artificial
  Chemically synthesized
ggaagguaggauuaaguagguga

SEQ ID NO: 4878 - RNA, 23 nt, artificial
  Chemically synthesized
gauuaaguaggugaguuuaauua

SEQ ID NO: 4879 - RNA, 23 nt, artificial
  Chemically synthesized
aggaagguaggauuaaguaggug

SEQ ID NO: 4880 - RNA, 23 nt, artificial
  Chemically synthesized
caggaagguaggauuaaguaggu

SEQ ID NO: 4881 - RNA, 23 nt, artificial
  Chemically synthesized
acaggaagguaggauuaaguagg

SEQ ID NO: 4882 - RNA, 23 nt, artificial
  Chemically synthesized
aacaggugugauccuguuacuga

SEQ ID NO: 4883 - RNA, 23 nt, artificial
  Chemically synthesized
cauggacuagcuucagggacuuu

SEQ ID NO: 4884 - RNA, 23 nt, artificial
  Chemically synthesized
ucauggacuagcuucagggacuu

SEQ ID NO: 4885 - RNA, 23 nt, artificial
  Chemically synthesized
cucauggacuagcuucagggacu

SEQ ID NO: 4886 - RNA, 23 nt, artificial
  Chemically synthesized
gcucauggacuagcuucagggac

SEQ ID NO: 4887 - RNA, 23 nt, artificial
  Chemically synthesized
ugcucauggacuagcuucaggga

SEQ ID NO: 4888 - RNA, 23 nt, artificial
  Chemically synthesized
auuugaaggguuuuuagacagga

SEQ ID NO: 4889 - RNA, 23 nt, artificial
  Chemically synthesized
acaacagugauugaaggguccua

SEQ ID NO: 4890 - RNA, 23 nt, artificial
  Chemically synthesized
uguacagaauugaaugggaugga

SEQ ID NO: 4891 - RNA, 23 nt, artificial
  Chemically synthesized
uuguacagaauugaaugggaugg

SEQ ID NO: 4892 - RNA, 23 nt, artificial
  Chemically synthesized
uuuguacagaauugaaugggaug

SEQ ID NO: 4893 - RNA, 23 nt, artificial
  Chemically synthesized
uuuuguacagaauugaaugggau

SEQ ID NO: 4894 - RNA, 23 nt, artificial
  Chemically synthesized
uuuuuguacagaauugaauggga

SEQ ID NO: 4895 - RNA, 23 nt, artificial
  Chemically synthesized
cucaacgagguaauauuugagga

SEQ ID NO: 4896 - RNA, 23 nt, artificial
  Chemically synthesized
ccucaacgagguaauauuugagg

SEQ ID NO: 4897 - RNA, 23 nt, artificial
  Chemically synthesized
accucaacgagguaauauuugag

SEQ ID NO: 4898 - RNA, 23 nt, artificial
  Chemically synthesized
aaccucaacgagguaauauuuga

SEQ ID NO: 4899 - RNA, 23 nt, artificial
  Chemically synthesized
ucucugggcuuuucugggaauug

SEQ ID NO: 4900 - RNA, 23 nt, artificial
  Chemically synthesized
aucucugggcuuuucugggaauu

SEQ ID NO: 4901 - RNA, 23 nt, artificial
  Chemically synthesized
caucucugggcuuuucugggaau

SEQ ID NO: 4902 - RNA, 23 nt, artificial
  Chemically synthesized
ucaucucugggcuuuucugggaa

SEQ ID NO: 4903 - RNA, 23 nt, artificial
  Chemically synthesized
ggcuugcgagguuguguuaugca

SEQ ID NO: 4904 - RNA, 23 nt, artificial
  Chemically synthesized
cggcuugcgagguuguguuaugc

SEQ ID NO: 4905 - RNA, 23 nt, artificial
  Chemically synthesized
gcggcuugcgagguuguguuaug

SEQ ID NO: 4906 - RNA, 23 nt, artificial
  Chemically synthesized
ugcggcuugcgagguuguguuau

SEQ ID NO: 4907 - RNA, 23 nt, artificial
  Chemically synthesized
cugcggcuugcgagguuguguua

SEQ ID NO: 4908 - RNA, 23 nt, artificial
  Chemically synthesized
uacggcaauaauggaacugcuuc

SEQ ID NO: 4909 - RNA, 23 nt, artificial
  Chemically synthesized
uuacggcaauaauggaacugcuu

SEQ ID NO: 4910 - RNA, 23 nt, artificial
  Chemically synthesized
auuacggcaauaauggaacugcu

SEQ ID NO: 4911 - RNA, 23 nt, artificial
  Chemically synthesized
cuuuacucacugauuggaacaac

SEQ ID NO: 4912 - RNA, 23 nt, artificial
  Chemically synthesized
acuuuacucacugauuggaacaa

SEQ ID NO: 4913 - RNA, 23 nt, artificial
  Chemically synthesized
aacuuuacucacugauuggaaca

SEQ ID NO: 4914 - RNA, 23 nt, artificial
  Chemically synthesized
aaacuuuacucacugauuggaac

SEQ ID NO: 4915 - RNA, 23 nt, artificial
  Chemically synthesized
aaaacuuuacucacugauuggaa

SEQ ID NO: 4916 - RNA, 23 nt, artificial
  Chemically synthesized
uuuuagacaggaagguaggauua

SEQ ID NO: 4917 - RNA, 23 nt, artificial
  Chemically synthesized
ugacuuccucacucuaauguuuu

SEQ ID NO: 4918 - RNA, 23 nt, artificial
  Chemically synthesized
ggacuuuuucuuuaguagagguc

SEQ ID NO: 4919 - RNA, 23 nt, artificial
  Chemically synthesized
gggacuuuuucuuuaguagaggu

SEQ ID NO: 4920 - RNA, 23 nt, artificial
  Chemically synthesized
agggacuuuuucuuuaguagagg

SEQ ID NO: 4921 - RNA, 23 nt, artificial
  Chemically synthesized
cagggacuuuuucuuuaguagag

SEQ ID NO: 4922 - RNA, 23 nt, artificial
  Chemically synthesized
ucagggacuuuuucuuuaguaga

SEQ ID NO: 4923 - RNA, 23 nt, artificial
  Chemically synthesized
cucugauucacuuaguaaucuau

SEQ ID NO: 4924 - RNA, 23 nt, artificial
  Chemically synthesized
ucucugauucacuuaguaaucua

SEQ ID NO: 4925 - RNA, 23 nt, artificial
  Chemically synthesized
gggaauaauaaaggccuuauuuu

SEQ ID NO: 4926 - RNA, 23 nt, artificial
  Chemically synthesized
agggaauaauaaaggccuuauuu

SEQ ID NO: 4927 - RNA, 23 nt, artificial
  Chemically synthesized
uagggaauaauaaaggccuuauu

SEQ ID NO: 4928 - RNA, 23 nt, artificial
  Chemically synthesized
cuagggaauaauaaaggccuuau

SEQ ID NO: 4929 - RNA, 23 nt, artificial
  Chemically synthesized
acuagggaauaauaaaggccuua

SEQ ID NO: 4930 - RNA, 23 nt, artificial
  Chemically synthesized
aauaccugugaggauaggaaauu

SEQ ID NO: 4931 - RNA, 23 nt, artificial
  Chemically synthesized
gaauaccugugaggauaggaaau

SEQ ID NO: 4932 - RNA, 23 nt, artificial
  Chemically synthesized
ugaauaccugugaggauaggaaa

SEQ ID NO: 4933 - RNA, 23 nt, artificial
  Chemically synthesized
ccuuggauaccugucacuaggga

SEQ ID NO: 4934 - RNA, 23 nt, artificial
  Chemically synthesized
cuagcuucagggacuuuuucuuu

SEQ ID NO: 4935 - RNA, 23 nt, artificial
  Chemically synthesized
acuagcuucagggacuuuuucuu

SEQ ID NO: 4936 - RNA, 23 nt, artificial
  Chemically synthesized
gacuagcuucagggacuuuuucu

SEQ ID NO: 4937 - RNA, 23 nt, artificial
  Chemically synthesized
ggacuagcuucagggacuuuuuc

SEQ ID NO: 4938 - RNA, 23 nt, artificial
  Chemically synthesized
uggacuagcuucagggacuuuuu

SEQ ID NO: 4939 - RNA, 23 nt, artificial
  Chemically synthesized
aaagauacuacaaagccaaucuu

SEQ ID NO: 4940 - RNA, 23 nt, artificial
  Chemically synthesized
aagcuggauaggauuguguguga

SEQ ID NO: 4941 - RNA, 23 nt, artificial
  Chemically synthesized
uguggugccauuucaguaaccac

SEQ ID NO: 4942 - RNA, 23 nt, artificial
  Chemically synthesized
uuguggugccauuucaguaacca

SEQ ID NO: 4943 - RNA, 23 nt, artificial
  Chemically synthesized
cuuguggugccauuucaguaacc

SEQ ID NO: 4944 - RNA, 23 nt, artificial
  Chemically synthesized
gcuuguggugccauuucaguaac

SEQ ID NO: 4945 - RNA, 23 nt, artificial
  Chemically synthesized
agcuuguggugccauuucaguaa

SEQ ID NO: 4946 - RNA, 23 nt, artificial
  Chemically synthesized
cuuuauagaauugggccaagaua

SEQ ID NO: 4947 - RNA, 23 nt, artificial
  Chemically synthesized
guuucagguaggcuugguaauag

SEQ ID NO: 4948 - RNA, 23 nt, artificial
  Chemically synthesized
gguuucagguaggcuugguaaua

SEQ ID NO: 4949 - RNA, 23 nt, artificial
  Chemically synthesized
ugguuucagguaggcuugguaau

SEQ ID NO: 4950 - RNA, 23 nt, artificial
  Chemically synthesized
uugguuucagguaggcuugguaa

SEQ ID NO: 4951 - RNA, 23 nt, artificial
  Chemically synthesized
uuugguuucagguaggcuuggua

SEQ ID NO: 4952 - RNA, 23 nt, artificial
  Chemically synthesized
ugggucguggauaaggagcuuau

SEQ ID NO: 4953 - RNA, 23 nt, artificial
  Chemically synthesized
gugggucguggauaaggagcuua

SEQ ID NO: 4954 - RNA, 23 nt, artificial
  Chemically synthesized
aauggugauggcuuauggaaggc

SEQ ID NO: 4955 - RNA, 23 nt, artificial
  Chemically synthesized
aaauggugauggcuuauggaagg

SEQ ID NO: 4956 - RNA, 23 nt, artificial
  Chemically synthesized
aaaauggugauggcuuauggaag

SEQ ID NO: 4957 - RNA, 23 nt, artificial
  Chemically synthesized
caaaauggugauggcuuauggaa

SEQ ID NO: 4958 - RNA, 23 nt, artificial
  Chemically synthesized
aagcuuguggugccauuucagua

SEQ ID NO: 4959 - RNA, 23 nt, artificial
  Chemically synthesized
aaagcuuguggugccauuucagu

SEQ ID NO: 4960 - RNA, 23 nt, artificial
  Chemically synthesized
aaaagcuuguggugccauuucag

SEQ ID NO: 4961 - RNA, 23 nt, artificial
  Chemically synthesized
uagguaagcaaaaguagaagccc

SEQ ID NO: 4962 - RNA, 23 nt, artificial
  Chemically synthesized
ugauuuucuggccuuuggagaag

SEQ ID NO: 4963 - RNA, 23 nt, artificial
  Chemically synthesized
cugauuuucuggccuuuggagaa

SEQ ID NO: 4964 - RNA, 23 nt, artificial
  Chemically synthesized
gcugauuuucuggccuuuggaga

SEQ ID NO: 4965 - RNA, 23 nt, artificial
  Chemically synthesized
aggcugauuuucuggccuuugga

SEQ ID NO: 4966 - RNA, 23 nt, artificial
  Chemically synthesized
aggcuucuugggcaucgauguag

SEQ ID NO: 4967 - RNA, 23 nt, artificial
  Chemically synthesized
aaggcuucuugggcaucgaugua

SEQ ID NO: 4968 - RNA, 23 nt, artificial
  Chemically synthesized
caaggcuucuugggcaucgaugu

SEQ ID NO: 4969 - RNA, 23 nt, artificial
  Chemically synthesized
ccguccagauaaccaugcaugca

SEQ ID NO: 4970 - RNA, 23 nt, artificial
  Chemically synthesized
accguccagauaaccaugcaugc

SEQ ID NO: 4971 - RNA, 23 nt, artificial
  Chemically synthesized
caccguccagauaaccaugcaug

SEQ ID NO: 4972 - RNA, 23 nt, artificial
  Chemically synthesized
ucaccguccagauaaccaugcau

SEQ ID NO: 4973 - RNA, 23 nt, artificial
  Chemically synthesized
cucaccguccagauaaccaugca

SEQ ID NO: 4974 - RNA, 23 nt, artificial
  Chemically synthesized
aaccaugcaugcacccagauuuu

SEQ ID NO: 4975 - RNA, 23 nt, artificial
  Chemically synthesized
uaaccaugcaugcacccagauuu

SEQ ID NO: 4976 - RNA, 23 nt, artificial
  Chemically synthesized
auaaccaugcaugcacccagauu

SEQ ID NO: 4977 - RNA, 23 nt, artificial
  Chemically synthesized
gauaaccaugcaugcacccagau

SEQ ID NO: 4978 - RNA, 23 nt, artificial
  Chemically synthesized
agauaaccaugcaugcacccaga

SEQ ID NO: 4979 - RNA, 23 nt, artificial
  Chemically synthesized
gaauugggccaagauaaaucaau

SEQ ID NO: 4980 - RNA, 23 nt, artificial
  Chemically synthesized
gugaggauaggaaauuaguucug

SEQ ID NO: 4981 - RNA, 23 nt, artificial
  Chemically synthesized
ugugaggauaggaaauuaguucu

SEQ ID NO: 4982 - RNA, 23 nt, artificial
  Chemically synthesized
gauuuuuuccaccuuggauaccu

SEQ ID NO: 4983 - RNA, 23 nt, artificial
  Chemically synthesized
gaagcccauuugaguuuuacauu

SEQ ID NO: 4984 - RNA, 23 nt, artificial
  Chemically synthesized
agaagcccauuugaguuuuacau

SEQ ID NO: 4985 - RNA, 23 nt, artificial
  Chemically synthesized
uagaagcccauuugaguuuuaca

SEQ ID NO: 4986 - RNA, 23 nt, artificial
  Chemically synthesized
guagaagcccauuugaguuuuac

SEQ ID NO: 4987 - RNA, 23 nt, artificial
  Chemically synthesized
aguagaagcccauuugaguuuua

SEQ ID NO: 4988 - RNA, 23 nt, artificial
  Chemically synthesized
agcaggagaacugcucauggacu

SEQ ID NO: 4989 - RNA, 23 nt, artificial
  Chemically synthesized
aagcaggagaacugcucauggac

SEQ ID NO: 4990 - RNA, 23 nt, artificial
  Chemically synthesized
uaagcaggagaacugcucaugga

SEQ ID NO: 4991 - RNA, 23 nt, artificial
  Chemically synthesized
gcaugcacccagauuuuuuccac

SEQ ID NO: 4992 - RNA, 23 nt, artificial
  Chemically synthesized
ugcaugcacccagauuuuuucca

SEQ ID NO: 4993 - RNA, 23 nt, artificial
  Chemically synthesized
augcaugcacccagauuuuuucc

SEQ ID NO: 4994 - RNA, 23 nt, artificial
  Chemically synthesized
caugcaugcacccagauuuuuuc

SEQ ID NO: 4995 - RNA, 23 nt, artificial
  Chemically synthesized
ccaugcaugcacccagauuuuuu

SEQ ID NO: 4996 - RNA, 23 nt, artificial
  Chemically synthesized
ccugcuaagugauuuugacuacu

SEQ ID NO: 4997 - RNA, 23 nt, artificial
  Chemically synthesized
uacugggauuauguuguuccuga

SEQ ID NO: 4998 - RNA, 23 nt, artificial
  Chemically synthesized
cucuugccuguuaugcuuacaaa

SEQ ID NO: 4999 - RNA, 23 nt, artificial
  Chemically synthesized
ccaccuuggauaccugucacuag

SEQ ID NO: 5000 - RNA, 23 nt, artificial
  Chemically synthesized
uccaccuuggauaccugucacua

SEQ ID NO: 5001 - RNA, 23 nt, artificial
  Chemically synthesized
uuccaccuuggauaccugucacu

SEQ ID NO: 5002 - RNA, 23 nt, artificial
  Chemically synthesized
uuuccaccuuggauaccugucac

SEQ ID NO: 5003 - RNA, 23 nt, artificial
  Chemically synthesized
uuuuccaccuuggauaccuguca

SEQ ID NO: 5004 - RNA, 23 nt, artificial
  Chemically synthesized
uuucuggccuuuggagaagugau

SEQ ID NO: 5005 - RNA, 23 nt, artificial
  Chemically synthesized
uucugcauagaucccauuuuugu

SEQ ID NO: 5006 - RNA, 23 nt, artificial
  Chemically synthesized
uuucugcauagaucccauuuuug

SEQ ID NO: 5007 - RNA, 23 nt, artificial
  Chemically synthesized
uuuucugcauagaucccauuuuu

SEQ ID NO: 5008 - RNA, 23 nt, artificial
  Chemically synthesized
gaacccaaccucaacgagguaau

SEQ ID NO: 5009 - RNA, 23 nt, artificial
  Chemically synthesized
agaaacugacccagagaauugcu

SEQ ID NO: 5010 - RNA, 23 nt, artificial
  Chemically synthesized
uucuuggugacuuccucacucua

SEQ ID NO: 5011 - RNA, 23 nt, artificial
  Chemically synthesized
cacuagggaauaauaaaggccuu

SEQ ID NO: 5012 - RNA, 23 nt, artificial
  Chemically synthesized
ccuguuaugcuuacaaaauggug

SEQ ID NO: 5013 - RNA, 23 nt, artificial
  Chemically synthesized
aaaguagaagcccauuugaguuu

SEQ ID NO: 5014 - RNA, 23 nt, artificial
  Chemically synthesized
aaaaguagaagcccauuugaguu

SEQ ID NO: 5015 - RNA, 23 nt, artificial
  Chemically synthesized
caaaaguagaagcccauuugagu

SEQ ID NO: 5016 - RNA, 23 nt, artificial
  Chemically synthesized
gcaaaaguagaagcccauuugag

SEQ ID NO: 5017 - RNA, 23 nt, artificial
  Chemically synthesized
agcaaaaguagaagcccauuuga

SEQ ID NO: 5018 - RNA, 23 nt, artificial
  Chemically synthesized
gauuuugacuacugggauuaugu

SEQ ID NO: 5019 - RNA, 23 nt, artificial
  Chemically synthesized
ugauuuugacuacugggauuaug

SEQ ID NO: 5020 - RNA, 23 nt, artificial
  Chemically synthesized
gugauuuugacuacugggauuau

SEQ ID NO: 5021 - RNA, 23 nt, artificial
  Chemically synthesized
agugauuuugacuacugggauua

SEQ ID NO: 5022 - RNA, 23 nt, artificial
  Chemically synthesized
aagugauuuugacuacugggauu

SEQ ID NO: 5023 - RNA, 23 nt, artificial
  Chemically synthesized
ugauggcuuauggaaggcuguua

SEQ ID NO: 5024 - RNA, 23 nt, artificial
  Chemically synthesized
uguuguccuuuuuccacuaacag

SEQ ID NO: 5025 - RNA, 23 nt, artificial
  Chemically synthesized
cuguuguccuuuuuccacuaaca

SEQ ID NO: 5026 - RNA, 23 nt, artificial
  Chemically synthesized
acuguuguccuuuuuccacuaac

SEQ ID NO: 5027 - RNA, 23 nt, artificial
  Chemically synthesized
aacuguuguccuuuuuccacuaa

SEQ ID NO: 5028 - RNA, 23 nt, artificial
  Chemically synthesized
gaacuguuguccuuuuuccacua

SEQ ID NO: 5029 - RNA, 23 nt, artificial
  Chemically synthesized
gaccggcguagggacagauguau

SEQ ID NO: 5030 - RNA, 23 nt, artificial
  Chemically synthesized
aguguagauuuucugcauagauc

SEQ ID NO: 5031 - RNA, 23 nt, artificial
  Chemically synthesized
uaguguagauuuucugcauagau

SEQ ID NO: 5032 - RNA, 23 nt, artificial
  Chemically synthesized
auaguguagauuuucugcauaga

SEQ ID NO: 5033 - RNA, 23 nt, artificial
  Chemically synthesized
aauaguguagauuuucugcauag

SEQ ID NO: 5034 - RNA, 23 nt, artificial
  Chemically synthesized
aaauaguguagauuuucugcaua

SEQ ID NO: 5035 - RNA, 23 nt, artificial
  Chemically synthesized
accuuggauaccugucacuaggg

SEQ ID NO: 5036 - RNA, 23 nt, artificial
  Chemically synthesized
caccuuggauaccugucacuagg

SEQ ID NO: 5037 - RNA, 23 nt, artificial
  Chemically synthesized
cacccagauuuuuuccaccuugg

SEQ ID NO: 5038 - RNA, 23 nt, artificial
  Chemically synthesized
gcacccagauuuuuuccaccuug

SEQ ID NO: 5039 - RNA, 23 nt, artificial
  Chemically synthesized
gauaggaaauuaguucugagauc

SEQ ID NO: 5040 - RNA, 23 nt, artificial
  Chemically synthesized
ggauaggaaauuaguucugagau

SEQ ID NO: 5041 - RNA, 23 nt, artificial
  Chemically synthesized
aggauaggaaauuaguucugaga

SEQ ID NO: 5042 - RNA, 23 nt, artificial
  Chemically synthesized
gaggauaggaaauuaguucugag

SEQ ID NO: 5043 - RNA, 23 nt, artificial
  Chemically synthesized
ugaggauaggaaauuaguucuga

SEQ ID NO: 5044 - RNA, 23 nt, artificial
  Chemically synthesized
accugcccuaaauaagaaacccc

SEQ ID NO: 5045 - RNA, 23 nt, artificial
  Chemically synthesized
cagcuaaagucauuuguaguuug

SEQ ID NO: 5046 - RNA, 23 nt, artificial
  Chemically synthesized
ucagcuaaagucauuuguaguuu

SEQ ID NO: 5047 - RNA, 23 nt, artificial
  Chemically synthesized
gucagcuaaagucauuuguaguu

SEQ ID NO: 5048 - RNA, 23 nt, artificial
  Chemically synthesized
agucagcuaaagucauuuguagu

SEQ ID NO: 5049 - RNA, 23 nt, artificial
  Chemically synthesized
uagucagcuaaagucauuuguag

SEQ ID NO: 5050 - RNA, 23 nt, artificial
  Chemically synthesized
ggcuuuuuuuucucuaaguuuuc

SEQ ID NO: 5051 - RNA, 23 nt, artificial
  Chemically synthesized
uggcuuuuuuuucucuaaguuuu

SEQ ID NO: 5052 - RNA, 23 nt, artificial
  Chemically synthesized
auggcuuuuuuuucucuaaguuu

SEQ ID NO: 5053 - RNA, 23 nt, artificial
  Chemically synthesized
uauggcuuuuuuuucucuaaguu

SEQ ID NO: 5054 - RNA, 23 nt, artificial
  Chemically synthesized
auauggcuuuuuuuucucuaagu

SEQ ID NO: 5055 - RNA, 23 nt, artificial
  Chemically synthesized
uaugcacgugaacuuggaaauug

SEQ ID NO: 5056 - RNA, 23 nt, artificial
  Chemically synthesized
uuaugcacgugaacuuggaaauu

SEQ ID NO: 5057 - RNA, 23 nt, artificial
  Chemically synthesized
guuaugcacgugaacuuggaaau

SEQ ID NO: 5058 - RNA, 23 nt, artificial
  Chemically synthesized
uguuaugcacgugaacuuggaaa

SEQ ID NO: 5059 - RNA, 23 nt, artificial
  Chemically synthesized
guguuaugcacgugaacuuggaa

SEQ ID NO: 5060 - RNA, 23 nt, artificial
  Chemically synthesized
auggacuagcuucagggacuuuu

SEQ ID NO: 5061 - RNA, 23 nt, artificial
  Chemically synthesized
cguugaccaugguugcaacuggc

SEQ ID NO: 5062 - RNA, 23 nt, artificial
  Chemically synthesized
ccguugaccaugguugcaacugg

SEQ ID NO: 5063 - RNA, 23 nt, artificial
  Chemically synthesized
gccguugaccaugguugcaacug

SEQ ID NO: 5064 - RNA, 23 nt, artificial
  Chemically synthesized
agccguugaccaugguugcaacu

SEQ ID NO: 5065 - RNA, 23 nt, artificial
  Chemically synthesized
gagccguugaccaugguugcaac

SEQ ID NO: 5066 - RNA, 23 nt, artificial
  Chemically synthesized
ugcaugucuauuguuaagcucca

SEQ ID NO: 5067 - RNA, 23 nt, artificial
  Chemically synthesized
caauuuacgaagucugcauuggc

SEQ ID NO: 5068 - RNA, 23 nt, artificial
  Chemically synthesized
ucaauuuacgaagucugcauugg

SEQ ID NO: 5069 - RNA, 23 nt, artificial
  Chemically synthesized
gucaauuuacgaagucugcauug

SEQ ID NO: 5070 - RNA, 23 nt, artificial
  Chemically synthesized
ggucaauuuacgaagucugcauu

SEQ ID NO: 5071 - RNA, 23 nt, artificial
  Chemically synthesized
gggucaauuuacgaagucugcau

SEQ ID NO: 5072 - RNA, 23 nt, artificial
  Chemically synthesized
cuagucagcuaaagucauuugua

SEQ ID NO: 5073 - RNA, 23 nt, artificial
  Chemically synthesized
aaagcuggauaggauugugugug

SEQ ID NO: 5074 - RNA, 23 nt, artificial
  Chemically synthesized
aaaagcuggauaggauugugugu

SEQ ID NO: 5075 - RNA, 23 nt, artificial
  Chemically synthesized
guacagccuagagaaugaaacuc

SEQ ID NO: 5076 - RNA, 23 nt, artificial
  Chemically synthesized
gauucuagcgucguaccuacuuu

SEQ ID NO: 5077 - RNA, 23 nt, artificial
  Chemically synthesized
ugauucuagcgucguaccuacuu

SEQ ID NO: 5078 - RNA, 23 nt, artificial
  Chemically synthesized
gugauucuagcgucguaccuacu

SEQ ID NO: 5079 - RNA, 23 nt, artificial
  Chemically synthesized
ugugauucuagcgucguaccuac

SEQ ID NO: 5080 - RNA, 23 nt, artificial
  Chemically synthesized
gaucuagucccucucugauucac

SEQ ID NO: 5081 - RNA, 23 nt, artificial
  Chemically synthesized
cuaacaaacuaaacucuucaaau

SEQ ID NO: 5082 - RNA, 23 nt, artificial
  Chemically synthesized
ucuaacaaacuaaacucuucaaa

SEQ ID NO: 5083 - RNA, 23 nt, artificial
  Chemically synthesized
uucuaacaaacuaaacucuucaa

SEQ ID NO: 5084 - RNA, 23 nt, artificial
  Chemically synthesized
gacucaaauuugaaggguuuuua

SEQ ID NO: 5085 - RNA, 23 nt, artificial
  Chemically synthesized
ugacucaaauuugaaggguuuuu

SEQ ID NO: 5086 - RNA, 23 nt, artificial
  Chemically synthesized
cugacucaaauuugaaggguuuu

SEQ ID NO: 5087 - RNA, 23 nt, artificial
  Chemically synthesized
ccugacucaaauuugaaggguuu

SEQ ID NO: 5088 - RNA, 23 nt, artificial
  Chemically synthesized
uccugacucaaauuugaaggguu

SEQ ID NO: 5089 - RNA, 23 nt, artificial
  Chemically synthesized
uccacucaacaauguucaauuca

SEQ ID NO: 5090 - RNA, 23 nt, artificial
  Chemically synthesized
cuccacucaacaauguucaauuc

SEQ ID NO: 5091 - RNA, 23 nt, artificial
  Chemically synthesized
ccuccacucaacaauguucaauu

SEQ ID NO: 5092 - RNA, 23 nt, artificial
  Chemically synthesized
gccuccacucaacaauguucaau

SEQ ID NO: 5093 - RNA, 23 nt, artificial
  Chemically synthesized
agccuccacucaacaauguucaa

SEQ ID NO: 5094 - RNA, 23 nt, artificial
  Chemically synthesized
uguagauuuucugcauagauccc

SEQ ID NO: 5095 - RNA, 23 nt, artificial
  Chemically synthesized
guguagauuuucugcauagaucc

SEQ ID NO: 5096 - RNA, 23 nt, artificial
  Chemically synthesized
gcuauggagauaugguuuauagu

SEQ ID NO: 5097 - RNA, 23 nt, artificial
  Chemically synthesized
ggcuauggagauaugguuuauag

SEQ ID NO: 5098 - RNA, 23 nt, artificial
  Chemically synthesized
uggcuauggagauaugguuuaua

SEQ ID NO: 5099 - RNA, 23 nt, artificial
  Chemically synthesized
uuggcuauggagauaugguuuau

SEQ ID NO: 5100 - RNA, 23 nt, artificial
  Chemically synthesized
auuggcuauggagauaugguuua

SEQ ID NO: 5101 - RNA, 23 nt, artificial
  Chemically synthesized
guauacuaccacuuugaauuauu

SEQ ID NO: 5102 - RNA, 23 nt, artificial
  Chemically synthesized
uguauacuaccacuuugaauuau

SEQ ID NO: 5103 - RNA, 23 nt, artificial
  Chemically synthesized
cuguauacuaccacuuugaauua

SEQ ID NO: 5104 - RNA, 23 nt, artificial
  Chemically synthesized
gcuguauacuaccacuuugaauu

SEQ ID NO: 5105 - RNA, 23 nt, artificial
  Chemically synthesized
agcuguauacuaccacuuugaau

SEQ ID NO: 5106 - RNA, 23 nt, artificial
  Chemically synthesized
agagccguugaccaugguugcaa

SEQ ID NO: 5107 - RNA, 23 nt, artificial
  Chemically synthesized
gaauuauugaaacgggucaauuu

SEQ ID NO: 5108 - RNA, 23 nt, artificial
  Chemically synthesized
ugaauuauugaaacgggucaauu

SEQ ID NO: 5109 - RNA, 23 nt, artificial
  Chemically synthesized
uugaauuauugaaacgggucaau

SEQ ID NO: 5110 - RNA, 23 nt, artificial
  Chemically synthesized
uuugaauuauugaaacgggucaa

SEQ ID NO: 5111 - RNA, 23 nt, artificial
  Chemically synthesized
cuuugaauuauugaaacggguca

SEQ ID NO: 5112 - RNA, 23 nt, artificial
  Chemically synthesized
agcccauuugaguuuuacauuug

SEQ ID NO: 5113 - RNA, 23 nt, artificial
  Chemically synthesized
aagcccauuugaguuuuacauuu

SEQ ID NO: 5114 - RNA, 23 nt, artificial
  Chemically synthesized
aggauugugugugauucuagcgu

SEQ ID NO: 5115 - RNA, 23 nt, artificial
  Chemically synthesized
uaggauugugugugauucuagcg

SEQ ID NO: 5116 - RNA, 23 nt, artificial
  Chemically synthesized
auaggauugugugugauucuagc

SEQ ID NO: 5117 - RNA, 23 nt, artificial
  Chemically synthesized
gauaggauugugugugauucuag

SEQ ID NO: 5118 - RNA, 23 nt, artificial
  Chemically synthesized
caaaugcuuggaaagauacuaca

SEQ ID NO: 5119 - RNA, 23 nt, artificial
  Chemically synthesized
cauuggcuauggagauaugguuu

SEQ ID NO: 5120 - RNA, 23 nt, artificial
  Chemically synthesized
cuuuuuccacuaacaguuaucuu

SEQ ID NO: 5121 - RNA, 23 nt, artificial
  Chemically synthesized
ccuuuuuccacuaacaguuaucu

SEQ ID NO: 5122 - RNA, 23 nt, artificial
  Chemically synthesized
uccuuuuuccacuaacaguuauc

SEQ ID NO: 5123 - RNA, 23 nt, artificial
  Chemically synthesized
guccuuuuuccacuaacaguuau

SEQ ID NO: 5124 - RNA, 23 nt, artificial
  Chemically synthesized
uguccuuuuuccacuaacaguua

SEQ ID NO: 5125 - RNA, 23 nt, artificial
  Chemically synthesized
ugcacccagauuuuuuccaccuu

SEQ ID NO: 5126 - RNA, 23 nt, artificial
  Chemically synthesized
gguccuaaaaagggaaaauauau

SEQ ID NO: 5127 - RNA, 23 nt, artificial
  Chemically synthesized
gcuucagggacuuuuucuuuagu

SEQ ID NO: 5128 - RNA, 23 nt, artificial
  Chemically synthesized
agcuucagggacuuuuucuuuag

SEQ ID NO: 5129 - RNA, 23 nt, artificial
  Chemically synthesized
uagcuucagggacuuuuucuuua

SEQ ID NO: 5130 - RNA, 23 nt, artificial
  Chemically synthesized
cuaauguuuuaaagaggcaacaa

SEQ ID NO: 5131 - RNA, 23 nt, artificial
  Chemically synthesized
ggaauaauaaaggccuuauuuuu

SEQ ID NO: 5132 - RNA, 23 nt, artificial
  Chemically synthesized
uugcaugucuauuguuaagcucc

SEQ ID NO: 5133 - RNA, 23 nt, artificial
  Chemically synthesized
uuugcaugucuauuguuaagcuc

SEQ ID NO: 5134 - RNA, 23 nt, artificial
  Chemically synthesized
uuuugcaugucuauuguuaagcu

SEQ ID NO: 5135 - RNA, 23 nt, artificial
  Chemically synthesized
uagcuguauacuaccacuuugaa

SEQ ID NO: 5136 - RNA, 23 nt, artificial
  Chemically synthesized
guagcuguauacuaccacuuuga

SEQ ID NO: 5137 - RNA, 23 nt, artificial
  Chemically synthesized
guagauuuucugcauagauccca

SEQ ID NO: 5138 - RNA, 23 nt, artificial
  Chemically synthesized
uguguuaugcacgugaacuugga

SEQ ID NO: 5139 - RNA, 23 nt, artificial
  Chemically synthesized
gaaacugacccagagaauugcuc

SEQ ID NO: 5140 - RNA, 23 nt, artificial
  Chemically synthesized
gaaacucaccguccagauaacca

SEQ ID NO: 5141 - RNA, 23 nt, artificial
  Chemically synthesized
ugaaacucaccguccagauaacc

SEQ ID NO: 5142 - RNA, 23 nt, artificial
  Chemically synthesized
augaaacucaccguccagauaac

SEQ ID NO: 5143 - RNA, 23 nt, artificial
  Chemically synthesized
aaugaaacucaccguccagauaa

SEQ ID NO: 5144 - RNA, 23 nt, artificial
  Chemically synthesized
gaaacagagccguugaccauggu

SEQ ID NO: 5145 - RNA, 23 nt, artificial
  Chemically synthesized
ggaaacagagccguugaccaugg

SEQ ID NO: 5146 - RNA, 23 nt, artificial
  Chemically synthesized
aggaaacagagccguugaccaug

SEQ ID NO: 5147 - RNA, 23 nt, artificial
  Chemically synthesized
aaggaaacagagccguugaccau

SEQ ID NO: 5148 - RNA, 23 nt, artificial
  Chemically synthesized
gaaggaaacagagccguugacca

SEQ ID NO: 5149 - RNA, 23 nt, artificial
  Chemically synthesized
uacagccuagagaaugaaacuca

SEQ ID NO: 5150 - RNA, 23 nt, artificial
  Chemically synthesized
ggagaacucugauccucagcuca

SEQ ID NO: 5151 - RNA, 23 nt, artificial
  Chemically synthesized
aggagaacucugauccucagcuc

SEQ ID NO: 5152 - RNA, 23 nt, artificial
  Chemically synthesized
caggagaacucugauccucagcu

SEQ ID NO: 5153 - RNA, 23 nt, artificial
  Chemically synthesized
ucaggagaacucugauccucagc

SEQ ID NO: 5154 - RNA, 23 nt, artificial
  Chemically synthesized
uucaggagaacucugauccucag

SEQ ID NO: 5155 - RNA, 23 nt, artificial
  Chemically synthesized
uucagggacuuuuucuuuaguag

SEQ ID NO: 5156 - RNA, 23 nt, artificial
  Chemically synthesized
cuucagggacuuuuucuuuagua

SEQ ID NO: 5157 - RNA, 23 nt, artificial
  Chemically synthesized
aguugauuacucuuccauugagu

SEQ ID NO: 5158 - RNA, 23 nt, artificial
  Chemically synthesized
uaguugauuacucuuccauugag

SEQ ID NO: 5159 - RNA, 23 nt, artificial
  Chemically synthesized
guaguugauuacucuuccauuga

SEQ ID NO: 5160 - RNA, 23 nt, artificial
  Chemically synthesized
uguaguugauuacucuuccauug

SEQ ID NO: 5161 - RNA, 23 nt, artificial
  Chemically synthesized
guguaguugauuacucuuccauu

SEQ ID NO: 5162 - RNA, 23 nt, artificial
  Chemically synthesized
ggaacaacagugauugaaggguc

SEQ ID NO: 5163 - RNA, 23 nt, artificial
  Chemically synthesized
uggaacaacagugauugaagggu

SEQ ID NO: 5164 - RNA, 23 nt, artificial
  Chemically synthesized
uuggaacaacagugauugaaggg

SEQ ID NO: 5165 - RNA, 23 nt, artificial
  Chemically synthesized
auuggaacaacagugauugaagg

SEQ ID NO: 5166 - RNA, 23 nt, artificial
  Chemically synthesized
gauuggaacaacagugauugaag

SEQ ID NO: 5167 - RNA, 23 nt, artificial
  Chemically synthesized
caaagccaaucuuuauagaauug

SEQ ID NO: 5168 - RNA, 23 nt, artificial
  Chemically synthesized
acaaagccaaucuuuauagaauu

SEQ ID NO: 5169 - RNA, 23 nt, artificial
  Chemically synthesized
uacaaagccaaucuuuauagaau

SEQ ID NO: 5170 - RNA, 23 nt, artificial
  Chemically synthesized
cuacaaagccaaucuuuauagaa

SEQ ID NO: 5171 - RNA, 23 nt, artificial
  Chemically synthesized
acuacaaagccaaucuuuauaga

SEQ ID NO: 5172 - RNA, 23 nt, artificial
  Chemically synthesized
aaacgggucaauuuacgaagucu

SEQ ID NO: 5173 - RNA, 23 nt, artificial
  Chemically synthesized
gcaaggcuucuugggcaucgaug

SEQ ID NO: 5174 - RNA, 23 nt, artificial
  Chemically synthesized
ggcaaggcuucuugggcaucgau

SEQ ID NO: 5175 - RNA, 23 nt, artificial
  Chemically synthesized
gggcaaggcuucuugggcaucga

SEQ ID NO: 5176 - RNA, 23 nt, artificial
  Chemically synthesized
ucccugagaaacugacccagaga

SEQ ID NO: 5177 - RNA, 23 nt, artificial
  Chemically synthesized
gucccugagaaacugacccagag

SEQ ID NO: 5178 - RNA, 23 nt, artificial
  Chemically synthesized
ugucccugagaaacugacccaga

SEQ ID NO: 5179 - RNA, 23 nt, artificial
  Chemically synthesized
cugcauuggcuauggagauaugg

SEQ ID NO: 5180 - RNA, 23 nt, artificial
  Chemically synthesized
ucugcauuggcuauggagauaug

SEQ ID NO: 5181 - RNA, 23 nt, artificial
  Chemically synthesized
gucugcauuggcuauggagauau

SEQ ID NO: 5182 - RNA, 23 nt, artificial
  Chemically synthesized
agucugcauuggcuauggagaua

SEQ ID NO: 5183 - RNA, 23 nt, artificial
  Chemically synthesized
aagucugcauuggcuauggagau

SEQ ID NO: 5184 - RNA, 23 nt, artificial
  Chemically synthesized
gauugugugugauucuagcgucg

SEQ ID NO: 5185 - RNA, 23 nt, artificial
  Chemically synthesized
ggauugugugugauucuagcguc

SEQ ID NO: 5186 - RNA, 23 nt, artificial
  Chemically synthesized
gcuagucagcuaaagucauuugu

SEQ ID NO: 5187 - RNA, 23 nt, artificial
  Chemically synthesized
agcuagucagcuaaagucauuug

SEQ ID NO: 5188 - RNA, 23 nt, artificial
  Chemically synthesized
cagcuagucagcuaaagucauuu

SEQ ID NO: 5189 - RNA, 23 nt, artificial
  Chemically synthesized
ucagcuagucagcuaaagucauu

SEQ ID NO: 5190 - RNA, 23 nt, artificial
  Chemically synthesized
uucagcuagucagcuaaagucau

SEQ ID NO: 5191 - RNA, 23 nt, artificial
  Chemically synthesized
uguauucauccugguguuacuga

SEQ ID NO: 5192 - RNA, 23 nt, artificial
  Chemically synthesized
auguauucauccugguguuacug

SEQ ID NO: 5193 - RNA, 23 nt, artificial
  Chemically synthesized
gauguauucauccugguguuacu

SEQ ID NO: 5194 - RNA, 23 nt, artificial
  Chemically synthesized
ggguaguaaaacuauucagcuag

SEQ ID NO: 5195 - RNA, 23 nt, artificial
  Chemically synthesized
uggguaguaaaacuauucagcua

SEQ ID NO: 5196 - RNA, 23 nt, artificial
  Chemically synthesized
uuggguaguaaaacuauucagcu

SEQ ID NO: 5197 - RNA, 23 nt, artificial
  Chemically synthesized
auuggguaguaaaacuauucagc

SEQ ID NO: 5198 - RNA, 23 nt, artificial
  Chemically synthesized
ugauuggaacaacagugauugaa

SEQ ID NO: 5199 - RNA, 23 nt, artificial
  Chemically synthesized
cugauuggaacaacagugauuga

SEQ ID NO: 5200 - RNA, 23 nt, artificial
  Chemically synthesized
acugauuggaacaacagugauug

SEQ ID NO: 5201 - RNA, 23 nt, artificial
  Chemically synthesized
cacugauuggaacaacagugauu

SEQ ID NO: 5202 - RNA, 23 nt, artificial
  Chemically synthesized
caguuaucuuugacucucuugcc

SEQ ID NO: 5203 - RNA, 23 nt, artificial
  Chemically synthesized
acaguuaucuuugacucucuugc

SEQ ID NO: 5204 - RNA, 23 nt, artificial
  Chemically synthesized
aacaguuaucuuugacucucuug

SEQ ID NO: 5205 - RNA, 23 nt, artificial
  Chemically synthesized
uaacaguuaucuuugacucucuu

SEQ ID NO: 5206 - RNA, 23 nt, artificial
  Chemically synthesized
cuaacaguuaucuuugacucucu

SEQ ID NO: 5207 - RNA, 23 nt, artificial
  Chemically synthesized
cacaauuugguuucagguaggcu

SEQ ID NO: 5208 - RNA, 23 nt, artificial
  Chemically synthesized
ccacaauuugguuucagguaggc

SEQ ID NO: 5209 - RNA, 23 nt, artificial
  Chemically synthesized
uccacaauuugguuucagguagg

SEQ ID NO: 5210 - RNA, 23 nt, artificial
  Chemically synthesized
uuccacaauuugguuucagguag

SEQ ID NO: 5211 - RNA, 23 nt, artificial
  Chemically synthesized
auuccacaauuugguuucaggua

SEQ ID NO: 5212 - RNA, 23 nt, artificial
  Chemically synthesized
gagaagugauucaaaauagugua

SEQ ID NO: 5213 - RNA, 23 nt, artificial
  Chemically synthesized
gcuuuucugggaauugaaguauc

SEQ ID NO: 5214 - RNA, 23 nt, artificial
  Chemically synthesized
gaagucugcauuggcuauggaga

SEQ ID NO: 5215 - RNA, 23 nt, artificial
  Chemically synthesized
uacuacaaagccaaucuuuauag

SEQ ID NO: 5216 - RNA, 23 nt, artificial
  Chemically synthesized
auacuacaaagccaaucuuuaua

SEQ ID NO: 5217 - RNA, 23 nt, artificial
  Chemically synthesized
gauacuacaaagccaaucuuuau

SEQ ID NO: 5218 - RNA, 23 nt, artificial
  Chemically synthesized
agauacuacaaagccaaucuuua

SEQ ID NO: 5219 - RNA, 23 nt, artificial
  Chemically synthesized
aaaauaguguagauuuucugcau

SEQ ID NO: 5220 - RNA, 23 nt, artificial
  Chemically synthesized
aagcaaaaguagaagcccauuug

SEQ ID NO: 5221 - RNA, 23 nt, artificial
  Chemically synthesized
uaagcaaaaguagaagcccauuu

SEQ ID NO: 5222 - RNA, 23 nt, artificial
  Chemically synthesized
guaagcaaaaguagaagcccauu

SEQ ID NO: 5223 - RNA, 23 nt, artificial
  Chemically synthesized
cgggucaauuuacgaagucugca

SEQ ID NO: 5224 - RNA, 23 nt, artificial
  Chemically synthesized
acgggucaauuuacgaagucugc

SEQ ID NO: 5225 - RNA, 23 nt, artificial
  Chemically synthesized
aacgggucaauuuacgaagucug

SEQ ID NO: 5226 - RNA, 23 nt, artificial
  Chemically synthesized
ucacugauuggaacaacagugau

SEQ ID NO: 5227 - RNA, 23 nt, artificial
  Chemically synthesized
aauucagcaaggcuuucauaucc

SEQ ID NO: 5228 - RNA, 23 nt, artificial
  Chemically synthesized
caauucagcaaggcuuucauauc

SEQ ID NO: 5229 - RNA, 23 nt, artificial
  Chemically synthesized
ucaauucagcaaggcuuucauau

SEQ ID NO: 5230 - RNA, 23 nt, artificial
  Chemically synthesized
uucaauucagcaaggcuuucaua

SEQ ID NO: 5231 - RNA, 23 nt, artificial
  Chemically synthesized
guucaauucagcaaggcuuucau

SEQ ID NO: 5232 - RNA, 23 nt, artificial
  Chemically synthesized
augaauaccugugaggauaggaa

SEQ ID NO: 5233 - RNA, 23 nt, artificial
  Chemically synthesized
uuauuucaugauuggguaguaaa

SEQ ID NO: 5234 - RNA, 23 nt, artificial
  Chemically synthesized
agagagccugcuaagugauuuug

SEQ ID NO: 5235 - RNA, 23 nt, artificial
  Chemically synthesized
uuaacccuagguaagaguaaaug

SEQ ID NO: 5236 - RNA, 23 nt, artificial
  Chemically synthesized
cuuaacccuagguaagaguaaau

SEQ ID NO: 5237 - RNA, 23 nt, artificial
  Chemically synthesized
gcuuaacccuagguaagaguaaa

SEQ ID NO: 5238 - RNA, 23 nt, artificial
  Chemically synthesized
agcuuaacccuagguaagaguaa

SEQ ID NO: 5239 - RNA, 23 nt, artificial
  Chemically synthesized
agaacuguuguccuuuuuccacu

SEQ ID NO: 5240 - RNA, 23 nt, artificial
  Chemically synthesized
uagaacuguuguccuuuuuccac

SEQ ID NO: 5241 - RNA, 23 nt, artificial
  Chemically synthesized
guagaacuguuguccuuuuucca

SEQ ID NO: 5242 - RNA, 23 nt, artificial
  Chemically synthesized
gcauuucagaauugcuggacugu

SEQ ID NO: 5243 - RNA, 23 nt, artificial
  Chemically synthesized
agcauuucagaauugcuggacug

SEQ ID NO: 5244 - RNA, 23 nt, artificial
  Chemically synthesized
cagcauuucagaauugcuggacu

SEQ ID NO: 5245 - RNA, 23 nt, artificial
  Chemically synthesized
ccagcauuucagaauugcuggac

SEQ ID NO: 5246 - RNA, 23 nt, artificial
  Chemically synthesized
gccagcauuucagaauugcugga

SEQ ID NO: 5247 - RNA, 23 nt, artificial
  Chemically synthesized
guaccuacuuuugagcuuacacu

SEQ ID NO: 5248 - RNA, 23 nt, artificial
  Chemically synthesized
cguaccuacuuuugagcuuacac

SEQ ID NO: 5249 - RNA, 23 nt, artificial
  Chemically synthesized
ucguaccuacuuuugagcuuaca

SEQ ID NO: 5250 - RNA, 23 nt, artificial
  Chemically synthesized
gucguaccuacuuuugagcuuac

SEQ ID NO: 5251 - RNA, 23 nt, artificial
  Chemically synthesized
gucuuauuccaacuaaguagauc

SEQ ID NO: 5252 - RNA, 23 nt, artificial
  Chemically synthesized
ugucuuauuccaacuaaguagau

SEQ ID NO: 5253 - RNA, 23 nt, artificial
  Chemically synthesized
uugucuuauuccaacuaaguaga

SEQ ID NO: 5254 - RNA, 23 nt, artificial
  Chemically synthesized
uuugucuuauuccaacuaaguag

SEQ ID NO: 5255 - RNA, 23 nt, artificial
  Chemically synthesized
uuuugucuuauuccaacuaagua

SEQ ID NO: 5256 - RNA, 23 nt, artificial
  Chemically synthesized
uuguguuuaagcaggagaacugc

SEQ ID NO: 5257 - RNA, 23 nt, artificial
  Chemically synthesized
cuuguguuuaagcaggagaacug

SEQ ID NO: 5258 - RNA, 23 nt, artificial
  Chemically synthesized
acuuguguuuaagcaggagaacu

SEQ ID NO: 5259 - RNA, 23 nt, artificial
  Chemically synthesized
cacuuguguuuaagcaggagaac

SEQ ID NO: 5260 - RNA, 23 nt, artificial
  Chemically synthesized
acacuuguguuuaagcaggagaa

SEQ ID NO: 5261 - RNA, 23 nt, artificial
  Chemically synthesized
aacuugccagaauuugguuaaaa

SEQ ID NO: 5262 - RNA, 23 nt, artificial
  Chemically synthesized
ucuaauguuuuaaagaggcaaca

SEQ ID NO: 5263 - RNA, 23 nt, artificial
  Chemically synthesized
cucuaauguuuuaaagaggcaac

SEQ ID NO: 5264 - RNA, 23 nt, artificial
  Chemically synthesized
acucuaauguuuuaaagaggcaa

SEQ ID NO: 5265 - RNA, 23 nt, artificial
  Chemically synthesized
cacucuaauguuuuaaagaggca

SEQ ID NO: 5266 - RNA, 23 nt, artificial
  Chemically synthesized
cuaaguuuucagaggauuuuuua

SEQ ID NO: 5267 - RNA, 23 nt, artificial
  Chemically synthesized
ucuaaguuuucagaggauuuuuu

SEQ ID NO: 5268 - RNA, 23 nt, artificial
  Chemically synthesized
cucuaaguuuucagaggauuuuu

SEQ ID NO: 5269 - RNA, 23 nt, artificial
  Chemically synthesized
ucucuaaguuuucagaggauuuu

SEQ ID NO: 5270 - RNA, 23 nt, artificial
  Chemically synthesized
uucucuaaguuuucagaggauuu

SEQ ID NO: 5271 - RNA, 23 nt, artificial
  Chemically synthesized
ugguuuauaguacagccuagaga

SEQ ID NO: 5272 - RNA, 23 nt, artificial
  Chemically synthesized
augguuuauaguacagccuagag

SEQ ID NO: 5273 - RNA, 23 nt, artificial
  Chemically synthesized
uaugguuuauaguacagccuaga

SEQ ID NO: 5274 - RNA, 23 nt, artificial
  Chemically synthesized
auaugguuuauaguacagccuag

SEQ ID NO: 5275 - RNA, 23 nt, artificial
  Chemically synthesized
uccucugguuucaggagaacucu

SEQ ID NO: 5276 - RNA, 23 nt, artificial
  Chemically synthesized
cuccucugguuucaggagaacuc

SEQ ID NO: 5277 - RNA, 23 nt, artificial
  Chemically synthesized
ucuccucugguuucaggagaacu

SEQ ID NO: 5278 - RNA, 23 nt, artificial
  Chemically synthesized
uucuccucugguuucaggagaac

SEQ ID NO: 5279 - RNA, 23 nt, artificial
  Chemically synthesized
cuucuccucugguuucaggagaa

SEQ ID NO: 5280 - RNA, 23 nt, artificial
  Chemically synthesized
uguuguuuuagaugccuuuauaa

SEQ ID NO: 5281 - RNA, 23 nt, artificial
  Chemically synthesized
guguuguuuuagaugccuuuaua

SEQ ID NO: 5282 - RNA, 23 nt, artificial
  Chemically synthesized
gguguuguuuuagaugccuuuau

SEQ ID NO: 5283 - RNA, 23 nt, artificial
  Chemically synthesized
acgguguuguuuuagaugccuuu

SEQ ID NO: 5284 - RNA, 23 nt, artificial
  Chemically synthesized
uaagugauuuugacuacugggau

SEQ ID NO: 5285 - RNA, 23 nt, artificial
  Chemically synthesized
ggugauggcuuauggaaggcugu

SEQ ID NO: 5286 - RNA, 23 nt, artificial
  Chemically synthesized
uggugauggcuuauggaaggcug

SEQ ID NO: 5287 - RNA, 23 nt, artificial
  Chemically synthesized
auggugauggcuuauggaaggcu

SEQ ID NO: 5288 - RNA, 23 nt, artificial
  Chemically synthesized
auugucaaggguaguagcuguau

SEQ ID NO: 5289 - RNA, 23 nt, artificial
  Chemically synthesized
aauugucaaggguaguagcugua

SEQ ID NO: 5290 - RNA, 23 nt, artificial
  Chemically synthesized
caauugucaaggguaguagcugu

SEQ ID NO: 5291 - RNA, 23 nt, artificial
  Chemically synthesized
cgcuucuccucugguuucaggag

SEQ ID NO: 5292 - RNA, 23 nt, artificial
  Chemically synthesized
ucgcuucuccucugguuucagga

SEQ ID NO: 5293 - RNA, 23 nt, artificial
  Chemically synthesized
gucgcuucuccucugguuucagg

SEQ ID NO: 5294 - RNA, 23 nt, artificial
  Chemically synthesized
ggucgcuucuccucugguuucag

SEQ ID NO: 5295 - RNA, 23 nt, artificial
  Chemically synthesized
aggucgcuucuccucugguuuca

SEQ ID NO: 5296 - RNA, 23 nt, artificial
  Chemically synthesized
aucaauguuguuuugcaugucua

SEQ ID NO: 5297 - RNA, 23 nt, artificial
  Chemically synthesized
uucuagcgucguaccuacuuuug

SEQ ID NO: 5298 - RNA, 23 nt, artificial
  Chemically synthesized
auucuagcgucguaccuacuuuu

SEQ ID NO: 5299 - RNA, 23 nt, artificial
  Chemically synthesized
ccagauaaccaugcaugcaccca

SEQ ID NO: 5300 - RNA, 23 nt, artificial
  Chemically synthesized
uccagauaaccaugcaugcaccc

SEQ ID NO: 5301 - RNA, 23 nt, artificial
  Chemically synthesized
guccagauaaccaugcaugcacc

SEQ ID NO: 5302 - RNA, 23 nt, artificial
  Chemically synthesized
cguccagauaaccaugcaugcac

SEQ ID NO: 5303 - RNA, 23 nt, artificial
  Chemically synthesized
cuuccaaaagcccacaccaccag

SEQ ID NO: 5304 - RNA, 23 nt, artificial
  Chemically synthesized
acuuccaaaagcccacaccacca

SEQ ID NO: 5305 - RNA, 23 nt, artificial
  Chemically synthesized
aacuuccaaaagcccacaccacc

SEQ ID NO: 5306 - RNA, 23 nt, artificial
  Chemically synthesized
aaacuuccaaaagcccacaccac

SEQ ID NO: 5307 - RNA, 23 nt, artificial
  Chemically synthesized
aaaacuuccaaaagcccacacca

SEQ ID NO: 5308 - RNA, 23 nt, artificial
  Chemically synthesized
aguuaucuuugacucucuugccu

SEQ ID NO: 5309 - RNA, 23 nt, artificial
  Chemically synthesized
cuuaaguguugaauacugucuuu

SEQ ID NO: 5310 - RNA, 23 nt, artificial
  Chemically synthesized
ucuuaaguguugaauacugucuu

SEQ ID NO: 5311 - RNA, 23 nt, artificial
  Chemically synthesized
uucuuaaguguugaauacugucu

SEQ ID NO: 5312 - RNA, 23 nt, artificial
  Chemically synthesized
guucuuaaguguugaauacuguc

SEQ ID NO: 5313 - RNA, 23 nt, artificial
  Chemically synthesized
uguucuuaaguguugaauacugu

SEQ ID NO: 5314 - RNA, 23 nt, artificial
  Chemically synthesized
cauagcaacugcagcuaacaggc

SEQ ID NO: 5315 - RNA, 23 nt, artificial
  Chemically synthesized
ucauagcaacugcagcuaacagg

SEQ ID NO: 5316 - RNA, 23 nt, artificial
  Chemically synthesized
uucauagcaacugcagcuaacag

SEQ ID NO: 5317 - RNA, 23 nt, artificial
  Chemically synthesized
auucauagcaacugcagcuaaca

SEQ ID NO: 5318 - RNA, 23 nt, artificial
  Chemically synthesized
cauucauagcaacugcagcuaac

SEQ ID NO: 5319 - RNA, 23 nt, artificial
  Chemically synthesized
gaacccggccagcauuucagaau

SEQ ID NO: 5320 - RNA, 23 nt, artificial
  Chemically synthesized
ggccaagauaaaucaauguuguu

SEQ ID NO: 5321 - RNA, 23 nt, artificial
  Chemically synthesized
auauuacggcaauaauggaacug

SEQ ID NO: 5322 - RNA, 23 nt, artificial
  Chemically synthesized
aauauuacggcaauaauggaacu

SEQ ID NO: 5323 - RNA, 23 nt, artificial
  Chemically synthesized
aaauauuacggcaauaauggaac

SEQ ID NO: 5324 - RNA, 23 nt, artificial
  Chemically synthesized
gaaauauuacggcaauaauggaa

SEQ ID NO: 5325 - RNA, 23 nt, artificial
  Chemically synthesized
agaaauauuacggcaauaaugga

SEQ ID NO: 5326 - RNA, 23 nt, artificial
  Chemically synthesized
uaaaaagcuggauaggauugugu

SEQ ID NO: 5327 - RNA, 23 nt, artificial
  Chemically synthesized
auguuguuccugaacccaaccuc

SEQ ID NO: 5328 - RNA, 23 nt, artificial
  Chemically synthesized
uauguuguuccugaacccaaccu

SEQ ID NO: 5329 - RNA, 23 nt, artificial
  Chemically synthesized
uuauguuguuccugaacccaacc

SEQ ID NO: 5330 - RNA, 23 nt, artificial
  Chemically synthesized
auuauguuguuccugaacccaac

SEQ ID NO: 5331 - RNA, 23 nt, artificial
  Chemically synthesized
gauuauguuguuccugaacccaa

SEQ ID NO: 5332 - RNA, 23 nt, artificial
  Chemically synthesized
gguuucaggagaacucugauccu

SEQ ID NO: 5333 - RNA, 23 nt, artificial
  Chemically synthesized
ugguuucaggagaacucugaucc

SEQ ID NO: 5334 - RNA, 23 nt, artificial
  Chemically synthesized
cugguuucaggagaacucugauc

SEQ ID NO: 5335 - RNA, 23 nt, artificial
  Chemically synthesized
ucugguuucaggagaacucugau

SEQ ID NO: 5336 - RNA, 23 nt, artificial
  Chemically synthesized
cucugguuucaggagaacucuga

SEQ ID NO: 5337 - RNA, 23 nt, artificial
  Chemically synthesized
ccaugguugcaacuggcaguuug

SEQ ID NO: 5338 - RNA, 23 nt, artificial
  Chemically synthesized
accaugguugcaacuggcaguuu

SEQ ID NO: 5339 - RNA, 23 nt, artificial
  Chemically synthesized
gaccaugguugcaacuggcaguu

SEQ ID NO: 5340 - RNA, 23 nt, artificial
  Chemically synthesized
ugaccaugguugcaacuggcagu

SEQ ID NO: 5341 - RNA, 23 nt, artificial
  Chemically synthesized
ugugauccuguuacugauacuau

SEQ ID NO: 5342 - RNA, 23 nt, artificial
  Chemically synthesized
auuauuucaugauuggguaguaa

SEQ ID NO: 5343 - RNA, 23 nt, artificial
  Chemically synthesized
guuuuuagacaggaagguaggau

SEQ ID NO: 5344 - RNA, 23 nt, artificial
  Chemically synthesized
gguuuuuagacaggaagguagga

SEQ ID NO: 5345 - RNA, 23 nt, artificial
  Chemically synthesized
ggguuuuuagacaggaagguagg

SEQ ID NO: 5346 - RNA, 23 nt, artificial
  Chemically synthesized
aggguuuuuagacaggaagguag

SEQ ID NO: 5347 - RNA, 23 nt, artificial
  Chemically synthesized
agguuuccugcccuagcuauuag

SEQ ID NO: 5348 - RNA, 23 nt, artificial
  Chemically synthesized
cagguuuccugcccuagcuauua

SEQ ID NO: 5349 - RNA, 23 nt, artificial
  Chemically synthesized
ucagguuuccugcccuagcuauu

SEQ ID NO: 5350 - RNA, 23 nt, artificial
  Chemically synthesized
uucagguuuccugcccuagcuau

SEQ ID NO: 5351 - RNA, 23 nt, artificial
  Chemically synthesized
auucagguuuccugcccuagcua

SEQ ID NO: 5352 - RNA, 23 nt, artificial
  Chemically synthesized
caacaauguucaauucagcaagg

SEQ ID NO: 5353 - RNA, 23 nt, artificial
  Chemically synthesized
ucaacaauguucaauucagcaag

SEQ ID NO: 5354 - RNA, 23 nt, artificial
  Chemically synthesized
cucaacaauguucaauucagcaa

SEQ ID NO: 5355 - RNA, 23 nt, artificial
  Chemically synthesized
acucaacaauguucaauucagca

SEQ ID NO: 5356 - RNA, 23 nt, artificial
  Chemically synthesized
cacucaacaauguucaauucagc

SEQ ID NO: 5357 - RNA, 23 nt, artificial
  Chemically synthesized
ccucuuuucaguauuacaugugc

SEQ ID NO: 5358 - RNA, 23 nt, artificial
  Chemically synthesized
uccucuuuucaguauuacaugug

SEQ ID NO: 5359 - RNA, 23 nt, artificial
  Chemically synthesized
auccucuuuucaguauuacaugu

SEQ ID NO: 5360 - RNA, 23 nt, artificial
  Chemically synthesized
uauccucuuuucaguauuacaug

SEQ ID NO: 5361 - RNA, 23 nt, artificial
  Chemically synthesized
cuauccucuuuucaguauuacau

SEQ ID NO: 5362 - RNA, 23 nt, artificial
  Chemically synthesized
aguguugaauacugucuuuaaac

SEQ ID NO: 5363 - RNA, 23 nt, artificial
  Chemically synthesized
aaguguugaauacugucuuuaaa

SEQ ID NO: 5364 - RNA, 23 nt, artificial
  Chemically synthesized
uaaguguugaauacugucuuuaa

SEQ ID NO: 5365 - RNA, 23 nt, artificial
  Chemically synthesized
uuaaguguugaauacugucuuua

SEQ ID NO: 5366 - RNA, 23 nt, artificial
  Chemically synthesized
gaacaacagugauugaagggucc

SEQ ID NO: 5367 - RNA, 23 nt, artificial
  Chemically synthesized
ucuauccucuuuucaguauuaca

SEQ ID NO: 5368 - RNA, 23 nt, artificial
  Chemically synthesized
ggaaauuaguucugagaucuagu

SEQ ID NO: 5369 - RNA, 23 nt, artificial
  Chemically synthesized
aggaaauuaguucugagaucuag

SEQ ID NO: 5370 - RNA, 23 nt, artificial
  Chemically synthesized
uaggaaauuaguucugagaucua

SEQ ID NO: 5371 - RNA, 23 nt, artificial
  Chemically synthesized
auaggaaauuaguucugagaucu

SEQ ID NO: 5372 - RNA, 23 nt, artificial
  Chemically synthesized
uuguccuuuuuccacuaacaguu

SEQ ID NO: 5373 - RNA, 23 nt, artificial
  Chemically synthesized
uuuucuggccuuuggagaaguga

SEQ ID NO: 5374 - RNA, 23 nt, artificial
  Chemically synthesized
auuuucuggccuuuggagaagug

SEQ ID NO: 5375 - RNA, 23 nt, artificial
  Chemically synthesized
gauuuucuggccuuuggagaagu

SEQ ID NO: 5376 - RNA, 23 nt, artificial
  Chemically synthesized
agucccucucugauucacuuagu

SEQ ID NO: 5377 - RNA, 23 nt, artificial
  Chemically synthesized
uagucccucucugauucacuuag

SEQ ID NO: 5378 - RNA, 23 nt, artificial
  Chemically synthesized
cuagucccucucugauucacuua

SEQ ID NO: 5379 - RNA, 23 nt, artificial
  Chemically synthesized
ucuagucccucucugauucacuu

SEQ ID NO: 5380 - RNA, 23 nt, artificial
  Chemically synthesized
ucuuuauagaauugggccaagau

SEQ ID NO: 5381 - RNA, 23 nt, artificial
  Chemically synthesized
guuucaggagaacucugauccuc

SEQ ID NO: 5382 - RNA, 23 nt, artificial
  Chemically synthesized
ccuagcuauuagcuccacuucac

SEQ ID NO: 5383 - RNA, 23 nt, artificial
  Chemically synthesized
acucaaauuugaaggguuuuuag

SEQ ID NO: 5384 - RNA, 23 nt, artificial
  Chemically synthesized
cuaacaggcugauuuucuggccu

SEQ ID NO: 5385 - RNA, 23 nt, artificial
  Chemically synthesized
gcuaacaggcugauuuucuggcc

SEQ ID NO: 5386 - RNA, 23 nt, artificial
  Chemically synthesized
agcuaacaggcugauuuucuggc

SEQ ID NO: 5387 - RNA, 23 nt, artificial
  Chemically synthesized
cagcuaacaggcugauuuucugg

SEQ ID NO: 5388 - RNA, 23 nt, artificial
  Chemically synthesized
gcagcuaacaggcugauuuucug

SEQ ID NO: 5389 - RNA, 23 nt, artificial
  Chemically synthesized
caauguucaauucagcaaggcuu

SEQ ID NO: 5390 - RNA, 23 nt, artificial
  Chemically synthesized
acaauguucaauucagcaaggcu

SEQ ID NO: 5391 - RNA, 23 nt, artificial
  Chemically synthesized
aacaauguucaauucagcaaggc

SEQ ID NO: 5392 - RNA, 23 nt, artificial
  Chemically synthesized
ugguguuacugaaaaacaggugu

SEQ ID NO: 5393 - RNA, 23 nt, artificial
  Chemically synthesized
cugguguuacugaaaaacaggug

SEQ ID NO: 5394 - RNA, 23 nt, artificial
  Chemically synthesized
ccugguguuacugaaaaacaggu

SEQ ID NO: 5395 - RNA, 23 nt, artificial
  Chemically synthesized
guuccugaacccaaccucaacga

SEQ ID NO: 5396 - RNA, 23 nt, artificial
  Chemically synthesized
uguuccugaacccaaccucaacg

SEQ ID NO: 5397 - RNA, 23 nt, artificial
  Chemically synthesized
uuguuccugaacccaaccucaac

SEQ ID NO: 5398 - RNA, 23 nt, artificial
  Chemically synthesized
guuguuccugaacccaaccucaa

SEQ ID NO: 5399 - RNA, 23 nt, artificial
  Chemically synthesized
uguuguuccugaacccaaccuca

SEQ ID NO: 5400 - RNA, 23 nt, artificial
  Chemically synthesized
uuucaggagaacucugauccuca

SEQ ID NO: 5401 - RNA, 23 nt, artificial
  Chemically synthesized
caacuugccagaauuugguuaaa

SEQ ID NO: 5402 - RNA, 23 nt, artificial
  Chemically synthesized
ugcagcuaacaggcugauuuucu

SEQ ID NO: 5403 - RNA, 23 nt, artificial
  Chemically synthesized
cugcagcuaacaggcugauuuuc

SEQ ID NO: 5404 - RNA, 23 nt, artificial
  Chemically synthesized
acugcagcuaacaggcugauuuu

SEQ ID NO: 5405 - RNA, 23 nt, artificial
  Chemically synthesized
cccaaauguagucucuuuucuuu

SEQ ID NO: 5406 - RNA, 23 nt, artificial
  Chemically synthesized
ccccaaauguagucucuuuucuu

SEQ ID NO: 5407 - RNA, 23 nt, artificial
  Chemically synthesized
accccaaauguagucucuuuucu

SEQ ID NO: 5408 - RNA, 23 nt, artificial
  Chemically synthesized
aaccccaaauguagucucuuuuc

SEQ ID NO: 5409 - RNA, 23 nt, artificial
  Chemically synthesized
aaaccccaaauguagucucuuuu

SEQ ID NO: 5410 - RNA, 23 nt, artificial
  Chemically synthesized
accaugcaugcacccagauuuuu

SEQ ID NO: 5411 - RNA, 23 nt, artificial
  Chemically synthesized
ggaacugcuucacuguuucuugg

SEQ ID NO: 5412 - RNA, 23 nt, artificial
  Chemically synthesized
uggaacugcuucacuguuucuug

SEQ ID NO: 5413 - RNA, 23 nt, artificial
  Chemically synthesized
auggaacugcuucacuguuucuu

SEQ ID NO: 5414 - RNA, 23 nt, artificial
  Chemically synthesized
aauggaacugcuucacuguuucu

SEQ ID NO: 5415 - RNA, 23 nt, artificial
  Chemically synthesized
uaauggaacugcuucacuguuuc

SEQ ID NO: 5416 - RNA, 23 nt, artificial
  Chemically synthesized
ccaaagguucacuguguuucugc

SEQ ID NO: 5417 - RNA, 23 nt, artificial
  Chemically synthesized
uccaaagguucacuguguuucug

SEQ ID NO: 5418 - RNA, 23 nt, artificial
  Chemically synthesized
cuccaaagguucacuguguuucu

SEQ ID NO: 5419 - RNA, 23 nt, artificial
  Chemically synthesized
gcuccaaagguucacuguguuuc

SEQ ID NO: 5420 - RNA, 23 nt, artificial
  Chemically synthesized
agcuccaaagguucacuguguuu

SEQ ID NO: 5421 - RNA, 23 nt, artificial
  Chemically synthesized
gaaccauuucaccauggcagugu

SEQ ID NO: 5422 - RNA, 23 nt, artificial
  Chemically synthesized
ugaaccauuucaccauggcagug

SEQ ID NO: 5423 - RNA, 23 nt, artificial
  Chemically synthesized
augaaccauuucaccauggcagu

SEQ ID NO: 5424 - RNA, 23 nt, artificial
  Chemically synthesized
gaugaaccauuucaccauggcag

SEQ ID NO: 5425 - RNA, 23 nt, artificial
  Chemically synthesized
acuaaacuugguugcucaaaggu

SEQ ID NO: 5426 - RNA, 23 nt, artificial
  Chemically synthesized
aacuaaacuugguugcucaaagg

SEQ ID NO: 5427 - RNA, 23 nt, artificial
  Chemically synthesized
aaacuaaacuugguugcucaaag

SEQ ID NO: 5428 - RNA, 23 nt, artificial
  Chemically synthesized
caaacuaaacuugguugcucaaa

SEQ ID NO: 5429 - RNA, 23 nt, artificial
  Chemically synthesized
gcaaacuaaacuugguugcucaa

SEQ ID NO: 5430 - RNA, 23 nt, artificial
  Chemically synthesized
auuuucugcauagaucccauuuu

SEQ ID NO: 5431 - RNA, 23 nt, artificial
  Chemically synthesized
gauuuucugcauagaucccauuu

SEQ ID NO: 5432 - RNA, 23 nt, artificial
  Chemically synthesized
agauuuucugcauagaucccauu

SEQ ID NO: 5433 - RNA, 23 nt, artificial
  Chemically synthesized
uagauuuucugcauagaucccau

SEQ ID NO: 5434 - RNA, 23 nt, artificial
  Chemically synthesized
auuuacgaagucugcauuggcua

SEQ ID NO: 5435 - RNA, 23 nt, artificial
  Chemically synthesized
gaucauuaucucuuuccuuuuuu

SEQ ID NO: 5436 - RNA, 23 nt, artificial
  Chemically synthesized
agaucauuaucucuuuccuuuuu

SEQ ID NO: 5437 - RNA, 23 nt, artificial
  Chemically synthesized
uagaucauuaucucuuuccuuuu

SEQ ID NO: 5438 - RNA, 23 nt, artificial
  Chemically synthesized
guagaucauuaucucuuuccuuu

SEQ ID NO: 5439 - RNA, 23 nt, artificial
  Chemically synthesized
aguagaucauuaucucuuuccuu

SEQ ID NO: 5440 - RNA, 23 nt, artificial
  Chemically synthesized
gcauuggcuauggagauaugguu

SEQ ID NO: 5441 - RNA, 23 nt, artificial
  Chemically synthesized
gguaguagcuguauacuaccacu

SEQ ID NO: 5442 - RNA, 23 nt, artificial
  Chemically synthesized
ccaauugucaaggguaguagcug

SEQ ID NO: 5443 - RNA, 23 nt, artificial
  Chemically synthesized
cccaauugucaaggguaguagcu

SEQ ID NO: 5444 - RNA, 23 nt, artificial
  Chemically synthesized
ccccaauugucaaggguaguagc

SEQ ID NO: 5445 - RNA, 23 nt, artificial
  Chemically synthesized
accccaauugucaaggguaguag

SEQ ID NO: 5446 - RNA, 23 nt, artificial
  Chemically synthesized
aaccccaauugucaaggguagua

SEQ ID NO: 5447 - RNA, 23 nt, artificial
  Chemically synthesized
cuuaguaaucuauccucuuuuca

SEQ ID NO: 5448 - RNA, 23 nt, artificial
  Chemically synthesized
acuuaguaaucuauccucuuuuc

SEQ ID NO: 5449 - RNA, 23 nt, artificial
  Chemically synthesized
cacuuaguaaucuauccucuuuu

SEQ ID NO: 5450 - RNA, 23 nt, artificial
  Chemically synthesized
ucacuuaguaaucuauccucuuu

SEQ ID NO: 5451 - RNA, 23 nt, artificial
  Chemically synthesized
uucacuuaguaaucuauccucuu

SEQ ID NO: 5452 - RNA, 23 nt, artificial
  Chemically synthesized
cuggaguugucaccacugacugg

SEQ ID NO: 5453 - RNA, 23 nt, artificial
  Chemically synthesized
ccuggaguugucaccacugacug

SEQ ID NO: 5454 - RNA, 23 nt, artificial
  Chemically synthesized
uccuggaguugucaccacugacu

SEQ ID NO: 5455 - RNA, 23 nt, artificial
  Chemically synthesized
guccuggaguugucaccacugac

SEQ ID NO: 5456 - RNA, 23 nt, artificial
  Chemically synthesized
uguccuggaguugucaccacuga

SEQ ID NO: 5457 - RNA, 23 nt, artificial
  Chemically synthesized
caguuugagcagcaagaacccgg

SEQ ID NO: 5458 - RNA, 23 nt, artificial
  Chemically synthesized
cuacugggauuauguuguuccug

SEQ ID NO: 5459 - RNA, 23 nt, artificial
  Chemically synthesized
acuacugggauuauguuguuccu

SEQ ID NO: 5460 - RNA, 23 nt, artificial
  Chemically synthesized
gacuacugggauuauguuguucc

SEQ ID NO: 5461 - RNA, 23 nt, artificial
  Chemically synthesized
ugacuacugggauuauguuguuc

SEQ ID NO: 5462 - RNA, 23 nt, artificial
  Chemically synthesized
uugacuacugggauuauguuguu

SEQ ID NO: 5463 - RNA, 23 nt, artificial
  Chemically synthesized
uagggacagauguauucauccug

SEQ ID NO: 5464 - RNA, 23 nt, artificial
  Chemically synthesized
guagggacagauguauucauccu

SEQ ID NO: 5465 - RNA, 23 nt, artificial
  Chemically synthesized
cguagggacagauguauucaucc

SEQ ID NO: 5466 - RNA, 23 nt, artificial
  Chemically synthesized
caaucuuuauagaauugggccaa

SEQ ID NO: 5467 - RNA, 23 nt, artificial
  Chemically synthesized
ccaaucuuuauagaauugggcca

SEQ ID NO: 5468 - RNA, 23 nt, artificial
  Chemically synthesized
gccaaucuuuauagaauugggcc

SEQ ID NO: 5469 - RNA, 23 nt, artificial
  Chemically synthesized
agccaaucuuuauagaauugggc

SEQ ID NO: 5470 - RNA, 23 nt, artificial
  Chemically synthesized
aagccaaucuuuauagaauuggg

SEQ ID NO: 5471 - RNA, 23 nt, artificial
  Chemically synthesized
guuguccuuuuuccacuaacagu

SEQ ID NO: 5472 - RNA, 23 nt, artificial
  Chemically synthesized
guccuaaaaagggaaaauauaua

SEQ ID NO: 5473 - RNA, 23 nt, artificial
  Chemically synthesized
auuuagccuaucaaaacuuccaa

SEQ ID NO: 5474 - RNA, 23 nt, artificial
  Chemically synthesized
cuaaacucuucaaaugcuuggaa

SEQ ID NO: 5475 - RNA, 23 nt, artificial
  Chemically synthesized
acuaaacucuucaaaugcuugga

SEQ ID NO: 5476 - RNA, 23 nt, artificial
  Chemically synthesized
aacuaaacucuucaaaugcuugg

SEQ ID NO: 5477 - RNA, 23 nt, artificial
  Chemically synthesized
aaacuaaacucuucaaaugcuug

SEQ ID NO: 5478 - RNA, 23 nt, artificial
  Chemically synthesized
caaacuaaacucuucaaaugcuu

SEQ ID NO: 5479 - RNA, 23 nt, artificial
  Chemically synthesized
ugcgagguuguguuaugcacgug

SEQ ID NO: 5480 - RNA, 23 nt, artificial
  Chemically synthesized
uugcgagguuguguuaugcacgu

SEQ ID NO: 5481 - RNA, 23 nt, artificial
  Chemically synthesized
ucaacuugccagaauuugguuaa

SEQ ID NO: 5482 - RNA, 23 nt, artificial
  Chemically synthesized
caaaagcuuguggugccauuuca

SEQ ID NO: 5483 - RNA, 23 nt, artificial
  Chemically synthesized
acaaaagcuuguggugccauuuc

SEQ ID NO: 5484 - RNA, 23 nt, artificial
  Chemically synthesized
aacaaaagcuuguggugccauuu

SEQ ID NO: 5485 - RNA, 23 nt, artificial
  Chemically synthesized
caacaaaagcuuguggugccauu

SEQ ID NO: 5486 - RNA, 23 nt, artificial
  Chemically synthesized
gcaaggcuuucauauccuugcug

SEQ ID NO: 5487 - RNA, 23 nt, artificial
  Chemically synthesized
agcaaggcuuucauauccuugcu

SEQ ID NO: 5488 - RNA, 23 nt, artificial
  Chemically synthesized
cagcaaggcuuucauauccuugc

SEQ ID NO: 5489 - RNA, 23 nt, artificial
  Chemically synthesized
ucagcaaggcuuucauauccuug

SEQ ID NO: 5490 - RNA, 23 nt, artificial
  Chemically synthesized
uucagcaaggcuuucauauccuu

SEQ ID NO: 5491 - RNA, 23 nt, artificial
  Chemically synthesized
aagauacuacaaagccaaucuuu

SEQ ID NO: 5492 - RNA, 23 nt, artificial
  Chemically synthesized
ucagcucaggauuucgacuuguu

SEQ ID NO: 5493 - RNA, 23 nt, artificial
  Chemically synthesized
gcaguguuaucucaucucugggc

SEQ ID NO: 5494 - RNA, 23 nt, artificial
  Chemically synthesized
ggcaguguuaucucaucucuggg

SEQ ID NO: 5495 - RNA, 23 nt, artificial
  Chemically synthesized
uggcaguguuaucucaucucugg

SEQ ID NO: 5496 - RNA, 23 nt, artificial
  Chemically synthesized
auggcaguguuaucucaucucug

SEQ ID NO: 5497 - RNA, 23 nt, artificial
  Chemically synthesized
cauggcaguguuaucucaucucu

SEQ ID NO: 5498 - RNA, 23 nt, artificial
  Chemically synthesized
aucuuuauagaauugggccaaga

SEQ ID NO: 5499 - RNA, 23 nt, artificial
  Chemically synthesized
aaucuuuauagaauugggccaag

SEQ ID NO: 5500 - RNA, 23 nt, artificial
  Chemically synthesized
cccauuuuuguacagaauugaau

SEQ ID NO: 5501 - RNA, 23 nt, artificial
  Chemically synthesized
ucccauuuuuguacagaauugaa

SEQ ID NO: 5502 - RNA, 23 nt, artificial
  Chemically synthesized
aucccauuuuuguacagaauuga

SEQ ID NO: 5503 - RNA, 23 nt, artificial
  Chemically synthesized
gaucccauuuuuguacagaauug

SEQ ID NO: 5504 - RNA, 23 nt, artificial
  Chemically synthesized
agaucccauuuuuguacagaauu

SEQ ID NO: 5505 - RNA, 23 nt, artificial
  Chemically synthesized
guguguaguugauuacucuucca

SEQ ID NO: 5506 - RNA, 23 nt, artificial
  Chemically synthesized
uguguguaguugauuacucuucc

SEQ ID NO: 5507 - RNA, 23 nt, artificial
  Chemically synthesized
uuguguguaguugauuacucuuc

SEQ ID NO: 5508 - RNA, 23 nt, artificial
  Chemically synthesized
uuuguguguaguugauuacucuu

SEQ ID NO: 5509 - RNA, 23 nt, artificial
  Chemically synthesized
uuuuguguguaguugauuacucu

SEQ ID NO: 5510 - RNA, 23 nt, artificial
  Chemically synthesized
guaaaugagaaauauuacggcaa

SEQ ID NO: 5511 - RNA, 23 nt, artificial
  Chemically synthesized
augcacccagauuuuuuccaccu

SEQ ID NO: 5512 - RNA, 23 nt, artificial
  Chemically synthesized
caugcacccagauuuuuuccacc

SEQ ID NO: 5513 - RNA, 23 nt, artificial
  Chemically synthesized
uagaucccauuuuuguacagaau

SEQ ID NO: 5514 - RNA, 23 nt, artificial
  Chemically synthesized
auagaucccauuuuuguacagaa

SEQ ID NO: 5515 - RNA, 23 nt, artificial
  Chemically synthesized
cagaauugcuggacuguggcuau

SEQ ID NO: 5516 - RNA, 23 nt, artificial
  Chemically synthesized
ucagaauugcuggacuguggcua

SEQ ID NO: 5517 - RNA, 23 nt, artificial
  Chemically synthesized
uucagaauugcuggacuguggcu

SEQ ID NO: 5518 - RNA, 23 nt, artificial
  Chemically synthesized
uuucagaauugcuggacuguggc

SEQ ID NO: 5519 - RNA, 23 nt, artificial
  Chemically synthesized
auuucagaauugcuggacugugg

SEQ ID NO: 5520 - RNA, 23 nt, artificial
  Chemically synthesized
uuugacuacugggauuauguugu

SEQ ID NO: 5521 - RNA, 23 nt, artificial
  Chemically synthesized
uuuugacuacugggauuauguug

SEQ ID NO: 5522 - RNA, 23 nt, artificial
  Chemically synthesized
auuuugacuacugggauuauguu

SEQ ID NO: 5523 - RNA, 23 nt, artificial
  Chemically synthesized
gagaauugcucaagauguccugc

SEQ ID NO: 5524 - RNA, 23 nt, artificial
  Chemically synthesized
agagaauugcucaagauguccug

SEQ ID NO: 5525 - RNA, 23 nt, artificial
  Chemically synthesized
cagagaauugcucaagauguccu

SEQ ID NO: 5526 - RNA, 23 nt, artificial
  Chemically synthesized
uguagaacuguuguccuuuuucc

SEQ ID NO: 5527 - RNA, 23 nt, artificial
  Chemically synthesized
auguagaacuguuguccuuuuuc

SEQ ID NO: 5528 - RNA, 23 nt, artificial
  Chemically synthesized
gauguagaacuguuguccuuuuu

SEQ ID NO: 5529 - RNA, 23 nt, artificial
  Chemically synthesized
cgauguagaacuguuguccuuuu

SEQ ID NO: 5530 - RNA, 23 nt, artificial
  Chemically synthesized
ccauuuuuguacagaauugaaug

SEQ ID NO: 5531 - RNA, 23 nt, artificial
  Chemically synthesized
cuuaaucucagaugaaccauuuc

SEQ ID NO: 5532 - RNA, 23 nt, artificial
  Chemically synthesized
gcuuaaucucagaugaaccauuu

SEQ ID NO: 5533 - RNA, 23 nt, artificial
  Chemically synthesized
ugcuuaaucucagaugaaccauu

SEQ ID NO: 5534 - RNA, 23 nt, artificial
  Chemically synthesized
gaauuugguuaaaaugcuggaga

SEQ ID NO: 5535 - RNA, 23 nt, artificial
  Chemically synthesized
agaauuugguuaaaaugcuggag

SEQ ID NO: 5536 - RNA, 23 nt, artificial
  Chemically synthesized
cagaauuugguuaaaaugcugga

SEQ ID NO: 5537 - RNA, 23 nt, artificial
  Chemically synthesized
ccagaauuugguuaaaaugcugg

SEQ ID NO: 5538 - RNA, 23 nt, artificial
  Chemically synthesized
uuuuuagacaggaagguaggauu

SEQ ID NO: 5539 - RNA, 23 nt, artificial
  Chemically synthesized
uugaaguaucucuccuuaacccc

SEQ ID NO: 5540 - RNA, 23 nt, artificial
  Chemically synthesized
auugaaguaucucuccuuaaccc

SEQ ID NO: 5541 - RNA, 23 nt, artificial
  Chemically synthesized
aauugaaguaucucuccuuaacc

SEQ ID NO: 5542 - RNA, 23 nt, artificial
  Chemically synthesized
gaauugaaguaucucuccuuaac

SEQ ID NO: 5543 - RNA, 23 nt, artificial
  Chemically synthesized
ggaauugaaguaucucuccuuaa

SEQ ID NO: 5544 - RNA, 23 nt, artificial
  Chemically synthesized
cuuugacucucuugccuguuaug

SEQ ID NO: 5545 - RNA, 23 nt, artificial
  Chemically synthesized
ucuuugacucucuugccuguuau

SEQ ID NO: 5546 - RNA, 23 nt, artificial
  Chemically synthesized
aucuuugacucucuugccuguua

SEQ ID NO: 5547 - RNA, 23 nt, artificial
  Chemically synthesized
uaucuuugacucucuugccuguu

SEQ ID NO: 5548 - RNA, 23 nt, artificial
  Chemically synthesized
uuaucuuugacucucuugccugu

SEQ ID NO: 5549 - RNA, 23 nt, artificial
  Chemically synthesized
uguggcuaucacccagagagccu

SEQ ID NO: 5550 - RNA, 23 nt, artificial
  Chemically synthesized
cuguggcuaucacccagagagcc

SEQ ID NO: 5551 - RNA, 23 nt, artificial
  Chemically synthesized
acuguggcuaucacccagagagc

SEQ ID NO: 5552 - RNA, 23 nt, artificial
  Chemically synthesized
gacuguggcuaucacccagagag

SEQ ID NO: 5553 - RNA, 23 nt, artificial
  Chemically synthesized
ggacuguggcuaucacccagaga

SEQ ID NO: 5554 - RNA, 23 nt, artificial
  Chemically synthesized
auaaaggccuuauuuuuugucuu

SEQ ID NO: 5555 - RNA, 23 nt, artificial
  Chemically synthesized
caguguuaucucaucucugggcu

SEQ ID NO: 5556 - RNA, 23 nt, artificial
  Chemically synthesized
ugcaacuggcaguuugagcagca

SEQ ID NO: 5557 - RNA, 23 nt, artificial
  Chemically synthesized
uugcaacuggcaguuugagcagc

SEQ ID NO: 5558 - RNA, 23 nt, artificial
  Chemically synthesized
gauuauuucaugauuggguagua

SEQ ID NO: 5559 - RNA, 23 nt, artificial
  Chemically synthesized
agaugccuuuauaagcucaguuu

SEQ ID NO: 5560 - RNA, 23 nt, artificial
  Chemically synthesized
uagaugccuuuauaagcucaguu

SEQ ID NO: 5561 - RNA, 23 nt, artificial
  Chemically synthesized
uuagaugccuuuauaagcucagu

SEQ ID NO: 5562 - RNA, 23 nt, artificial
  Chemically synthesized
uuuagaugccuuuauaagcucag

SEQ ID NO: 5563 - RNA, 23 nt, artificial
  Chemically synthesized
uuuuagaugccuuuauaagcuca

SEQ ID NO: 5564 - RNA, 23 nt, artificial
  Chemically synthesized
guuaagcuccaaagguucacugu

SEQ ID NO: 5565 - RNA, 23 nt, artificial
  Chemically synthesized
uguuaagcuccaaagguucacug

SEQ ID NO: 5566 - RNA, 23 nt, artificial
  Chemically synthesized
uuguuaagcuccaaagguucacu

SEQ ID NO: 5567 - RNA, 23 nt, artificial
  Chemically synthesized
auuguuaagcuccaaagguucac

SEQ ID NO: 5568 - RNA, 23 nt, artificial
  Chemically synthesized
uauuguuaagcuccaaagguuca

SEQ ID NO: 5569 - RNA, 23 nt, artificial
  Chemically synthesized
gaguuuaguuuguuagaacacug

SEQ ID NO: 5570 - RNA, 23 nt, artificial
  Chemically synthesized
aguuuaguuuguuagaacacugg

SEQ ID NO: 5571 - RNA, 23 nt, artificial
  Chemically synthesized
guuuaguuuguuagaacacuggc

SEQ ID NO: 5572 - RNA, 23 nt, artificial
  Chemically synthesized
uuuaguuuguuagaacacuggcu

SEQ ID NO: 5573 - RNA, 23 nt, artificial
  Chemically synthesized
uuaguuuguuagaacacuggcua

SEQ ID NO: 5574 - RNA, 23 nt, artificial
  Chemically synthesized
uaguuuguuagaacacuggcuaa

SEQ ID NO: 5575 - RNA, 23 nt, artificial
  Chemically synthesized
uggguucaggaacaacauaaucc

SEQ ID NO: 5576 - RNA, 23 nt, artificial
  Chemically synthesized
ggguucaggaacaacauaauccc

SEQ ID NO: 5577 - RNA, 23 nt, artificial
  Chemically synthesized
gguucaggaacaacauaauccca

SEQ ID NO: 5578 - RNA, 23 nt, artificial
  Chemically synthesized
guucaggaacaacauaaucccag

SEQ ID NO: 5579 - RNA, 23 nt, artificial
  Chemically synthesized
uucaggaacaacauaaucccagu

SEQ ID NO: 5580 - RNA, 23 nt, artificial
  Chemically synthesized
auacuucaauucccagaaaagcc

SEQ ID NO: 5581 - RNA, 23 nt, artificial
  Chemically synthesized
uacuucaauucccagaaaagccc

SEQ ID NO: 5582 - RNA, 23 nt, artificial
  Chemically synthesized
acuucaauucccagaaaagccca

SEQ ID NO: 5583 - RNA, 23 nt, artificial
  Chemically synthesized
cuucaauucccagaaaagcccag

SEQ ID NO: 5584 - RNA, 23 nt, artificial
  Chemically synthesized
uucaauucccagaaaagcccaga

SEQ ID NO: 5585 - RNA, 23 nt, artificial
  Chemically synthesized
uacuuuugcuuaccuauuccauc

SEQ ID NO: 5586 - RNA, 23 nt, artificial
  Chemically synthesized
acuuuugcuuaccuauuccaucc

SEQ ID NO: 5587 - RNA, 23 nt, artificial
  Chemically synthesized
cuuuugcuuaccuauuccauccc

SEQ ID NO: 5588 - RNA, 23 nt, artificial
  Chemically synthesized
uuuugcuuaccuauuccauccca

SEQ ID NO: 5589 - RNA, 23 nt, artificial
  Chemically synthesized
uuugcuuaccuauuccaucccau

SEQ ID NO: 5590 - RNA, 23 nt, artificial
  Chemically synthesized
cauuuucaauuuccaaguucacg

SEQ ID NO: 5591 - RNA, 23 nt, artificial
  Chemically synthesized
auuuucaauuuccaaguucacgu

SEQ ID NO: 5592 - RNA, 23 nt, artificial
  Chemically synthesized
uuuucaauuuccaaguucacgug

SEQ ID NO: 5593 - RNA, 23 nt, artificial
  Chemically synthesized
uuucaauuuccaaguucacgugc

SEQ ID NO: 5594 - RNA, 23 nt, artificial
  Chemically synthesized
uucaauuuccaaguucacgugca

SEQ ID NO: 5595 - RNA, 23 nt, artificial
  Chemically synthesized
uugcuuaccuauuccaucccauu

SEQ ID NO: 5596 - RNA, 23 nt, artificial
  Chemically synthesized
aguuuguuagaacacuggcuaau

SEQ ID NO: 5597 - RNA, 23 nt, artificial
  Chemically synthesized
guuuguuagaacacuggcuaauu

SEQ ID NO: 5598 - RNA, 23 nt, artificial
  Chemically synthesized
uuuguuagaacacuggcuaauuu

SEQ ID NO: 5599 - RNA, 23 nt, artificial
  Chemically synthesized
ucccuuuuuaggacccuucaauc

SEQ ID NO: 5600 - RNA, 23 nt, artificial
  Chemically synthesized
cccuuuuuaggacccuucaauca

SEQ ID NO: 5601 - RNA, 23 nt, artificial
  Chemically synthesized
ccuuuuuaggacccuucaaucac

SEQ ID NO: 5602 - RNA, 23 nt, artificial
  Chemically synthesized
cuuuuuaggacccuucaaucacu

SEQ ID NO: 5603 - RNA, 23 nt, artificial
  Chemically synthesized
uuuuuaggacccuucaaucacug

SEQ ID NO: 5604 - RNA, 23 nt, artificial
  Chemically synthesized
auccucacagguauucaucauuc

SEQ ID NO: 5605 - RNA, 23 nt, artificial
  Chemically synthesized
uccucacagguauucaucauuca

SEQ ID NO: 5606 - RNA, 23 nt, artificial
  Chemically synthesized
ccucacagguauucaucauucac

SEQ ID NO: 5607 - RNA, 23 nt, artificial
  Chemically synthesized
cucacagguauucaucauucacu

SEQ ID NO: 5608 - RNA, 23 nt, artificial
  Chemically synthesized
ucacagguauucaucauucacuc

SEQ ID NO: 5609 - RNA, 23 nt, artificial
  Chemically synthesized
aaaaucacuuagcaggcucucug

SEQ ID NO: 5610 - RNA, 23 nt, artificial
  Chemically synthesized
aaaucacuuagcaggcucucugg

SEQ ID NO: 5611 - RNA, 23 nt, artificial
  Chemically synthesized
aaucacuuagcaggcucucuggg

SEQ ID NO: 5612 - RNA, 23 nt, artificial
  Chemically synthesized
aucacuuagcaggcucucugggu

SEQ ID NO: 5613 - RNA, 23 nt, artificial
  Chemically synthesized
ucacuuagcaggcucucugggug

SEQ ID NO: 5614 - RNA, 23 nt, artificial
  Chemically synthesized
uugauuuaucuuggcccaauucu

SEQ ID NO: 5615 - RNA, 23 nt, artificial
  Chemically synthesized
ugauuuaucuuggcccaauucua

SEQ ID NO: 5616 - RNA, 23 nt, artificial
  Chemically synthesized
gauuuaucuuggcccaauucuau

SEQ ID NO: 5617 - RNA, 23 nt, artificial
  Chemically synthesized
auuuaucuuggcccaauucuaua

SEQ ID NO: 5618 - RNA, 23 nt, artificial
  Chemically synthesized
uuuaucuuggcccaauucuauaa

SEQ ID NO: 5619 - RNA, 23 nt, artificial
  Chemically synthesized
cuccuuauccacgacccacagca

SEQ ID NO: 5620 - RNA, 23 nt, artificial
  Chemically synthesized
uccuuauccacgacccacagcaa

SEQ ID NO: 5621 - RNA, 23 nt, artificial
  Chemically synthesized
ccuuauccacgacccacagcaag

SEQ ID NO: 5622 - RNA, 23 nt, artificial
  Chemically synthesized
cuuauccacgacccacagcaagg

SEQ ID NO: 5623 - RNA, 23 nt, artificial
  Chemically synthesized
uuauccacgacccacagcaagga

SEQ ID NO: 5624 - RNA, 23 nt, artificial
  Chemically synthesized
auauuucucauuuacucuuaccu

SEQ ID NO: 5625 - RNA, 23 nt, artificial
  Chemically synthesized
uauuucucauuuacucuuaccua

SEQ ID NO: 5626 - RNA, 23 nt, artificial
  Chemically synthesized
auuucucauuuacucuuaccuag

SEQ ID NO: 5627 - RNA, 23 nt, artificial
  Chemically synthesized
uuucucauuuacucuuaccuagg

SEQ ID NO: 5628 - RNA, 23 nt, artificial
  Chemically synthesized
uucucauuuacucuuaccuaggg

SEQ ID NO: 5629 - RNA, 23 nt, artificial
  Chemically synthesized
uuaguuugcuuugauuuggacag

SEQ ID NO: 5630 - RNA, 23 nt, artificial
  Chemically synthesized
uaguuugcuuugauuuggacaga

SEQ ID NO: 5631 - RNA, 23 nt, artificial
  Chemically synthesized
aguuugcuuugauuuggacagac

SEQ ID NO: 5632 - RNA, 23 nt, artificial
  Chemically synthesized
guuugcuuugauuuggacagaca

SEQ ID NO: 5633 - RNA, 23 nt, artificial
  Chemically synthesized
uuugcuuugauuuggacagacag

SEQ ID NO: 5634 - RNA, 23 nt, artificial
  Chemically synthesized
auaguuuuacuacccaaucauga

SEQ ID NO: 5635 - RNA, 23 nt, artificial
  Chemically synthesized
uaguuuuacuacccaaucaugaa

SEQ ID NO: 5636 - RNA, 23 nt, artificial
  Chemically synthesized
aguuuuacuacccaaucaugaaa

SEQ ID NO: 5637 - RNA, 23 nt, artificial
  Chemically synthesized
guuuuacuacccaaucaugaaau

SEQ ID NO: 5638 - RNA, 23 nt, artificial
  Chemically synthesized
uuuuacuacccaaucaugaaaua

SEQ ID NO: 5639 - RNA, 23 nt, artificial
  Chemically synthesized
uuuuaggacccuucaaucacugu

SEQ ID NO: 5640 - RNA, 23 nt, artificial
  Chemically synthesized
uuuaggacccuucaaucacuguu

SEQ ID NO: 5641 - RNA, 23 nt, artificial
  Chemically synthesized
gaauauuaauuuaacagccuucc

SEQ ID NO: 5642 - RNA, 23 nt, artificial
  Chemically synthesized
aauauuaauuuaacagccuucca

SEQ ID NO: 5643 - RNA, 23 nt, artificial
  Chemically synthesized
auauuaauuuaacagccuuccau

SEQ ID NO: 5644 - RNA, 23 nt, artificial
  Chemically synthesized
uauuaauuuaacagccuuccaua

SEQ ID NO: 5645 - RNA, 23 nt, artificial
  Chemically synthesized
auuaauuuaacagccuuccauaa

SEQ ID NO: 5646 - RNA, 23 nt, artificial
  Chemically synthesized
guaguauacagcuacuacccuug

SEQ ID NO: 5647 - RNA, 23 nt, artificial
  Chemically synthesized
uaguauacagcuacuacccuuga

SEQ ID NO: 5648 - RNA, 23 nt, artificial
  Chemically synthesized
aguauacagcuacuacccuugac

SEQ ID NO: 5649 - RNA, 23 nt, artificial
  Chemically synthesized
guauacagcuacuacccuugaca

SEQ ID NO: 5650 - RNA, 23 nt, artificial
  Chemically synthesized
uauacagcuacuacccuugacaa

SEQ ID NO: 5651 - RNA, 23 nt, artificial
  Chemically synthesized
aaguuuaguuugcuuugauuugg

SEQ ID NO: 5652 - RNA, 23 nt, artificial
  Chemically synthesized
aguuuaguuugcuuugauuugga

SEQ ID NO: 5653 - RNA, 23 nt, artificial
  Chemically synthesized
guuuaguuugcuuugauuuggac

SEQ ID NO: 5654 - RNA, 23 nt, artificial
  Chemically synthesized
uuuaguuugcuuugauuuggaca

SEQ ID NO: 5655 - RNA, 23 nt, artificial
  Chemically synthesized
uaauuuaacagccuuccauaagc

SEQ ID NO: 5656 - RNA, 23 nt, artificial
  Chemically synthesized
aauuuaacagccuuccauaagcc

SEQ ID NO: 5657 - RNA, 23 nt, artificial
  Chemically synthesized
auuuaacagccuuccauaagcca

SEQ ID NO: 5658 - RNA, 23 nt, artificial
  Chemically synthesized
uuuaacagccuuccauaagccau

SEQ ID NO: 5659 - RNA, 23 nt, artificial
  Chemically synthesized
uuaacagccuuccauaagccauc

SEQ ID NO: 5660 - RNA, 23 nt, artificial
  Chemically synthesized
cacuuauaguaucaguaacagga

SEQ ID NO: 5661 - RNA, 23 nt, artificial
  Chemically synthesized
acuuauaguaucaguaacaggau

SEQ ID NO: 5662 - RNA, 23 nt, artificial
  Chemically synthesized
cuuauaguaucaguaacaggauc

SEQ ID NO: 5663 - RNA, 23 nt, artificial
  Chemically synthesized
uuauaguaucaguaacaggauca

SEQ ID NO: 5664 - RNA, 23 nt, artificial
  Chemically synthesized
uauaguaucaguaacaggaucac

SEQ ID NO: 5665 - RNA, 23 nt, artificial
  Chemically synthesized
ucaguuucucagggacaaggacc

SEQ ID NO: 5666 - RNA, 23 nt, artificial
  Chemically synthesized
caguuucucagggacaaggaccu

SEQ ID NO: 5667 - RNA, 23 nt, artificial
  Chemically synthesized
aguuucucagggacaaggaccuu

SEQ ID NO: 5668 - RNA, 23 nt, artificial
  Chemically synthesized
guuucucagggacaaggaccuuu

SEQ ID NO: 5669 - RNA, 23 nt, artificial
  Chemically synthesized
uuucucagggacaaggaccuuug

SEQ ID NO: 5670 - RNA, 23 nt, artificial
  Chemically synthesized
gagauaaugaucuacuuaguugg

SEQ ID NO: 5671 - RNA, 23 nt, artificial
  Chemically synthesized
agauaaugaucuacuuaguugga

SEQ ID NO: 5672 - RNA, 23 nt, artificial
  Chemically synthesized
gauaaugaucuacuuaguuggaa

SEQ ID NO: 5673 - RNA, 23 nt, artificial
  Chemically synthesized
auaaugaucuacuuaguuggaau

SEQ ID NO: 5674 - RNA, 23 nt, artificial
  Chemically synthesized
uaaugaucuacuuaguuggaaua

SEQ ID NO: 5675 - RNA, 23 nt, artificial
  Chemically synthesized
acaguucuccagcauuuuaacca

SEQ ID NO: 5676 - RNA, 23 nt, artificial
  Chemically synthesized
caguucuccagcauuuuaaccaa

SEQ ID NO: 5677 - RNA, 23 nt, artificial
  Chemically synthesized
aguucuccagcauuuuaaccaaa

SEQ ID NO: 5678 - RNA, 23 nt, artificial
  Chemically synthesized
guucuccagcauuuuaaccaaau

SEQ ID NO: 5679 - RNA, 23 nt, artificial
  Chemically synthesized
uucuccagcauuuuaaccaaauu

SEQ ID NO: 5680 - RNA, 23 nt, artificial
  Chemically synthesized
gguauucaucauucacucaaugg

SEQ ID NO: 5681 - RNA, 23 nt, artificial
  Chemically synthesized
guauucaucauucacucaaugga

SEQ ID NO: 5682 - RNA, 23 nt, artificial
  Chemically synthesized
uauucaucauucacucaauggaa

SEQ ID NO: 5683 - RNA, 23 nt, artificial
  Chemically synthesized
auucaucauucacucaauggaag

SEQ ID NO: 5684 - RNA, 23 nt, artificial
  Chemically synthesized
uucaucauucacucaauggaaga

SEQ ID NO: 5685 - RNA, 23 nt, artificial
  Chemically synthesized
auuguugaguggaggcuaaauuc

SEQ ID NO: 5686 - RNA, 23 nt, artificial
  Chemically synthesized
uuguugaguggaggcuaaauucu

SEQ ID NO: 5687 - RNA, 23 nt, artificial
  Chemically synthesized
uguugaguggaggcuaaauucuc

SEQ ID NO: 5688 - RNA, 23 nt, artificial
  Chemically synthesized
guugaguggaggcuaaauucucu

SEQ ID NO: 5689 - RNA, 23 nt, artificial
  Chemically synthesized
uugaguggaggcuaaauucucuc

SEQ ID NO: 5690 - RNA, 23 nt, artificial
  Chemically synthesized
uuucuuaacaagucgaaauccug

SEQ ID NO: 5691 - RNA, 23 nt, artificial
  Chemically synthesized
uucuuaacaagucgaaauccuga

SEQ ID NO: 5692 - RNA, 23 nt, artificial
  Chemically synthesized
ucuuaacaagucgaaauccugag

SEQ ID NO: 5693 - RNA, 23 nt, artificial
  Chemically synthesized
cuuaacaagucgaaauccugagc

SEQ ID NO: 5694 - RNA, 23 nt, artificial
  Chemically synthesized
uuaacaagucgaaauccugagcu

SEQ ID NO: 5695 - RNA, 23 nt, artificial
  Chemically synthesized
ucaauuuccaaguucacgugcau

SEQ ID NO: 5696 - RNA, 23 nt, artificial
  Chemically synthesized
uaguaucaguaacaggaucacac

SEQ ID NO: 5697 - RNA, 23 nt, artificial
  Chemically synthesized
aguaucaguaacaggaucacacc

SEQ ID NO: 5698 - RNA, 23 nt, artificial
  Chemically synthesized
guaucaguaacaggaucacaccu

SEQ ID NO: 5699 - RNA, 23 nt, artificial
  Chemically synthesized
uaucaguaacaggaucacaccug

SEQ ID NO: 5700 - RNA, 23 nt, artificial
  Chemically synthesized
aucaguaacaggaucacaccugu

SEQ ID NO: 5701 - RNA, 23 nt, artificial
  Chemically synthesized
gagauuaagcacauguaauacug

SEQ ID NO: 5702 - RNA, 23 nt, artificial
  Chemically synthesized
agauuaagcacauguaauacuga

SEQ ID NO: 5703 - RNA, 23 nt, artificial
  Chemically synthesized
gauuaagcacauguaauacugaa

SEQ ID NO: 5704 - RNA, 23 nt, artificial
  Chemically synthesized
auuaagcacauguaauacugaaa

SEQ ID NO: 5705 - RNA, 23 nt, artificial
  Chemically synthesized
uuaagcacauguaauacugaaaa

SEQ ID NO: 5706 - RNA, 23 nt, artificial
  Chemically synthesized
gguuucuuauuuagggcaggugg

SEQ ID NO: 5707 - RNA, 23 nt, artificial
  Chemically synthesized
guuucuuauuuagggcagguggg

SEQ ID NO: 5708 - RNA, 23 nt, artificial
  Chemically synthesized
uuucuuauuuagggcaggugggg

SEQ ID NO: 5709 - RNA, 23 nt, artificial
  Chemically synthesized
uucuuauuuagggcagguggggc

SEQ ID NO: 5710 - RNA, 23 nt, artificial
  Chemically synthesized
ucuuauuuagggcagguggggca

SEQ ID NO: 5711 - RNA, 23 nt, artificial
  Chemically synthesized
aauauuucucauuuacucuuacc

SEQ ID NO: 5712 - RNA, 23 nt, artificial
  Chemically synthesized
uugauuuggacagacaguucucc

SEQ ID NO: 5713 - RNA, 23 nt, artificial
  Chemically synthesized
ugauuuggacagacaguucucca

SEQ ID NO: 5714 - RNA, 23 nt, artificial
  Chemically synthesized
gauuuggacagacaguucuccag

SEQ ID NO: 5715 - RNA, 23 nt, artificial
  Chemically synthesized
auuuggacagacaguucuccagc

SEQ ID NO: 5716 - RNA, 23 nt, artificial
  Chemically synthesized
uuuggacagacaguucuccagca

SEQ ID NO: 5717 - RNA, 23 nt, artificial
  Chemically synthesized
uugauuccucaaauauuaccucg

SEQ ID NO: 5718 - RNA, 23 nt, artificial
  Chemically synthesized
ugauuccucaaauauuaccucgu

SEQ ID NO: 5719 - RNA, 23 nt, artificial
  Chemically synthesized
gauuccucaaauauuaccucguu

SEQ ID NO: 5720 - RNA, 23 nt, artificial
  Chemically synthesized
auuccucaaauauuaccucguug

SEQ ID NO: 5721 - RNA, 23 nt, artificial
  Chemically synthesized
uuccucaaauauuaccucguuga

SEQ ID NO: 5722 - RNA, 23 nt, artificial
  Chemically synthesized
ggcuuuguaguaucuuuccaagc

SEQ ID NO: 5723 - RNA, 23 nt, artificial
  Chemically synthesized
gcuuuguaguaucuuuccaagca

SEQ ID NO: 5724 - RNA, 23 nt, artificial
  Chemically synthesized
cuuuguaguaucuuuccaagcau

SEQ ID NO: 5725 - RNA, 23 nt, artificial
  Chemically synthesized
uuuguaguaucuuuccaagcauu

SEQ ID NO: 5726 - RNA, 23 nt, artificial
  Chemically synthesized
uuguaguaucuuuccaagcauuu

SEQ ID NO: 5727 - RNA, 23 nt, artificial
  Chemically synthesized
uaauuugaacagugacauuuuag

SEQ ID NO: 5728 - RNA, 23 nt, artificial
  Chemically synthesized
aauuugaacagugacauuuuagg

SEQ ID NO: 5729 - RNA, 23 nt, artificial
  Chemically synthesized
auuugaacagugacauuuuaggu

SEQ ID NO: 5730 - RNA, 23 nt, artificial
  Chemically synthesized
uuugaacagugacauuuuagguc

SEQ ID NO: 5731 - RNA, 23 nt, artificial
  Chemically synthesized
uugaacagugacauuuuagguca

SEQ ID NO: 5732 - RNA, 23 nt, artificial
  Chemically synthesized
aaacauuagagugaggaagucac

SEQ ID NO: 5733 - RNA, 23 nt, artificial
  Chemically synthesized
aacauuagagugaggaagucacc

SEQ ID NO: 5734 - RNA, 23 nt, artificial
  Chemically synthesized
acauuagagugaggaagucacca

SEQ ID NO: 5735 - RNA, 23 nt, artificial
  Chemically synthesized
cauuagagugaggaagucaccaa

SEQ ID NO: 5736 - RNA, 23 nt, artificial
  Chemically synthesized
auuagagugaggaagucaccaag

SEQ ID NO: 5737 - RNA, 23 nt, artificial
  Chemically synthesized
ugcuuaccuauuccaucccauuc

SEQ ID NO: 5738 - RNA, 23 nt, artificial
  Chemically synthesized
gcuuaccuauuccaucccauuca

SEQ ID NO: 5739 - RNA, 23 nt, artificial
  Chemically synthesized
cuuaccuauuccaucccauucaa

SEQ ID NO: 5740 - RNA, 23 nt, artificial
  Chemically synthesized
uuaccuauuccaucccauucaau

SEQ ID NO: 5741 - RNA, 23 nt, artificial
  Chemically synthesized
uaccuauuccaucccauucaauu

SEQ ID NO: 5742 - RNA, 23 nt, artificial
  Chemically synthesized
accauuuuguaagcauaacaggc

SEQ ID NO: 5743 - RNA, 23 nt, artificial
  Chemically synthesized
ccauuuuguaagcauaacaggca

SEQ ID NO: 5744 - RNA, 23 nt, artificial
  Chemically synthesized
cauuuuguaagcauaacaggcaa

SEQ ID NO: 5745 - RNA, 23 nt, artificial
  Chemically synthesized
auuuuguaagcauaacaggcaag

SEQ ID NO: 5746 - RNA, 23 nt, artificial
  Chemically synthesized
uuuuguaagcauaacaggcaaga

SEQ ID NO: 5747 - RNA, 23 nt, artificial
  Chemically synthesized
auagucuauuaccaagccuaccu

SEQ ID NO: 5748 - RNA, 23 nt, artificial
  Chemically synthesized
uagucuauuaccaagccuaccug

SEQ ID NO: 5749 - RNA, 23 nt, artificial
  Chemically synthesized
agucuauuaccaagccuaccuga

SEQ ID NO: 5750 - RNA, 23 nt, artificial
  Chemically synthesized
gucuauuaccaagccuaccugaa

SEQ ID NO: 5751 - RNA, 23 nt, artificial
  Chemically synthesized
ucuauuaccaagccuaccugaaa

SEQ ID NO: 5752 - RNA, 23 nt, artificial
  Chemically synthesized
uccuauccucacagguauucauc

SEQ ID NO: 5753 - RNA, 23 nt, artificial
  Chemically synthesized
ccuauccucacagguauucauca

SEQ ID NO: 5754 - RNA, 23 nt, artificial
  Chemically synthesized
cuauccucacagguauucaucau

SEQ ID NO: 5755 - RNA, 23 nt, artificial
  Chemically synthesized
uauccucacagguauucaucauu

SEQ ID NO: 5756 - RNA, 23 nt, artificial
  Chemically synthesized
ccuuuauuauucccuagugacag

SEQ ID NO: 5757 - RNA, 23 nt, artificial
  Chemically synthesized
cuuuauuauucccuagugacagg

SEQ ID NO: 5758 - RNA, 23 nt, artificial
  Chemically synthesized
uuuauuauucccuagugacaggu

SEQ ID NO: 5759 - RNA, 23 nt, artificial
  Chemically synthesized
uuauuauucccuagugacaggua

SEQ ID NO: 5760 - RNA, 23 nt, artificial
  Chemically synthesized
uauuauucccuagugacagguau

SEQ ID NO: 5761 - RNA, 23 nt, artificial
  Chemically synthesized
agcuuuuguugccucuuuaaaac

SEQ ID NO: 5762 - RNA, 23 nt, artificial
  Chemically synthesized
gcuuuuguugccucuuuaaaaca

SEQ ID NO: 5763 - RNA, 23 nt, artificial
  Chemically synthesized
cuuuuguugccucuuuaaaacau

SEQ ID NO: 5764 - RNA, 23 nt, artificial
  Chemically synthesized
uuuuguugccucuuuaaaacauu

SEQ ID NO: 5765 - RNA, 23 nt, artificial
  Chemically synthesized
uuuguugccucuuuaaaacauua

SEQ ID NO: 5766 - RNA, 23 nt, artificial
  Chemically synthesized
aagaguuuaguuuguuagaacac

SEQ ID NO: 5767 - RNA, 23 nt, artificial
  Chemically synthesized
agaguuuaguuuguuagaacacu

SEQ ID NO: 5768 - RNA, 23 nt, artificial
  Chemically synthesized
guuuauauagucuauuaccaagc

SEQ ID NO: 5769 - RNA, 23 nt, artificial
  Chemically synthesized
uuuauauagucuauuaccaagcc

SEQ ID NO: 5770 - RNA, 23 nt, artificial
  Chemically synthesized
uuauauagucuauuaccaagccu

SEQ ID NO: 5771 - RNA, 23 nt, artificial
  Chemically synthesized
uauauagucuauuaccaagccua

SEQ ID NO: 5772 - RNA, 23 nt, artificial
  Chemically synthesized
auauagucuauuaccaagccuac

SEQ ID NO: 5773 - RNA, 23 nt, artificial
  Chemically synthesized
uguuuuucaguaacaccaggaug

SEQ ID NO: 5774 - RNA, 23 nt, artificial
  Chemically synthesized
guuuuucaguaacaccaggauga

SEQ ID NO: 5775 - RNA, 23 nt, artificial
  Chemically synthesized
uuuuucaguaacaccaggaugaa

SEQ ID NO: 5776 - RNA, 23 nt, artificial
  Chemically synthesized
uuuucaguaacaccaggaugaau

SEQ ID NO: 5777 - RNA, 23 nt, artificial
  Chemically synthesized
uuucaguaacaccaggaugaaua

SEQ ID NO: 5778 - RNA, 23 nt, artificial
  Chemically synthesized
ggcuuuuggaaguuuugauaggc

SEQ ID NO: 5779 - RNA, 23 nt, artificial
  Chemically synthesized
gcuuuuggaaguuuugauaggcu

SEQ ID NO: 5780 - RNA, 23 nt, artificial
  Chemically synthesized
cuuuuggaaguuuugauaggcua

SEQ ID NO: 5781 - RNA, 23 nt, artificial
  Chemically synthesized
uuuuggaaguuuugauaggcuaa

SEQ ID NO: 5782 - RNA, 23 nt, artificial
  Chemically synthesized
uuuggaaguuuugauaggcuaaa

SEQ ID NO: 5783 - RNA, 23 nt, artificial
  Chemically synthesized
ccuguuuuucaguaacaccagga

SEQ ID NO: 5784 - RNA, 23 nt, artificial
  Chemically synthesized
cuguuuuucaguaacaccaggau

SEQ ID NO: 5785 - RNA, 23 nt, artificial
  Chemically synthesized
aggcaucuaaaacaacaccgugg

SEQ ID NO: 5786 - RNA, 23 nt, artificial
  Chemically synthesized
ggcaucuaaaacaacaccguggu

SEQ ID NO: 5787 - RNA, 23 nt, artificial
  Chemically synthesized
gcaucuaaaacaacaccgugguu

SEQ ID NO: 5788 - RNA, 23 nt, artificial
  Chemically synthesized
caucuaaaacaacaccgugguua

SEQ ID NO: 5789 - RNA, 23 nt, artificial
  Chemically synthesized
aucuaaaacaacaccgugguuac

SEQ ID NO: 5790 - RNA, 23 nt, artificial
  Chemically synthesized
uccauaagccaucaccauuuugu

SEQ ID NO: 5791 - RNA, 23 nt, artificial
  Chemically synthesized
ccauaagccaucaccauuuugua

SEQ ID NO: 5792 - RNA, 23 nt, artificial
  Chemically synthesized
cauaagccaucaccauuuuguaa

SEQ ID NO: 5793 - RNA, 23 nt, artificial
  Chemically synthesized
auaagccaucaccauuuuguaag

SEQ ID NO: 5794 - RNA, 23 nt, artificial
  Chemically synthesized
uaagccaucaccauuuuguaagc

SEQ ID NO: 5795 - RNA, 23 nt, artificial
  Chemically synthesized
cggguucuugcugcucaaacugc

SEQ ID NO: 5796 - RNA, 23 nt, artificial
  Chemically synthesized
ggguucuugcugcucaaacugcc

SEQ ID NO: 5797 - RNA, 23 nt, artificial
  Chemically synthesized
gguucuugcugcucaaacugcca

SEQ ID NO: 5798 - RNA, 23 nt, artificial
  Chemically synthesized
guucuugcugcucaaacugccag

SEQ ID NO: 5799 - RNA, 23 nt, artificial
  Chemically synthesized
uucuugcugcucaaacugccagu

SEQ ID NO: 5800 - RNA, 23 nt, artificial
  Chemically synthesized
uggcuuuguaguaucuuuccaag

SEQ ID NO: 5801 - RNA, 23 nt, artificial
  Chemically synthesized
uagguacgacgcuagaaucacac

SEQ ID NO: 5802 - RNA, 23 nt, artificial
  Chemically synthesized
agguacgacgcuagaaucacaca

SEQ ID NO: 5803 - RNA, 23 nt, artificial
  Chemically synthesized
gguacgacgcuagaaucacacac

SEQ ID NO: 5804 - RNA, 23 nt, artificial
  Chemically synthesized
guacgacgcuagaaucacacaca

SEQ ID NO: 5805 - RNA, 23 nt, artificial
  Chemically synthesized
uacgacgcuagaaucacacacaa

SEQ ID NO: 5806 - RNA, 23 nt, artificial
  Chemically synthesized
acaguucuacaucgaugcccaag

SEQ ID NO: 5807 - RNA, 23 nt, artificial
  Chemically synthesized
caguucuacaucgaugcccaaga

SEQ ID NO: 5808 - RNA, 23 nt, artificial
  Chemically synthesized
aguucuacaucgaugcccaagaa

SEQ ID NO: 5809 - RNA, 23 nt, artificial
  Chemically synthesized
guucuacaucgaugcccaagaag

SEQ ID NO: 5810 - RNA, 23 nt, artificial
  Chemically synthesized
uucuacaucgaugcccaagaagc

SEQ ID NO: 5811 - RNA, 23 nt, artificial
  Chemically synthesized
ucaauucccagaaaagcccagag

SEQ ID NO: 5812 - RNA, 23 nt, artificial
  Chemically synthesized
ugcuuugauuuggacagacaguu

SEQ ID NO: 5813 - RNA, 23 nt, artificial
  Chemically synthesized
gcuuugauuuggacagacaguuc

SEQ ID NO: 5814 - RNA, 23 nt, artificial
  Chemically synthesized
cuuugauuuggacagacaguucu

SEQ ID NO: 5815 - RNA, 23 nt, artificial
  Chemically synthesized
uuugauuuggacagacaguucuc

SEQ ID NO: 5816 - RNA, 23 nt, artificial
  Chemically synthesized
auuuucccuuuuuaggacccuuc

SEQ ID NO: 5817 - RNA, 23 nt, artificial
  Chemically synthesized
uuuucccuuuuuaggacccuuca

SEQ ID NO: 5818 - RNA, 23 nt, artificial
  Chemically synthesized
uuucccuuuuuaggacccuucaa

SEQ ID NO: 5819 - RNA, 23 nt, artificial
  Chemically synthesized
uucccuuuuuaggacccuucaau

SEQ ID NO: 5820 - RNA, 23 nt, artificial
  Chemically synthesized
acucuuaccuaggguuaagcuuu

SEQ ID NO: 5821 - RNA, 23 nt, artificial
  Chemically synthesized
cucuuaccuaggguuaagcuuua

SEQ ID NO: 5822 - RNA, 23 nt, artificial
  Chemically synthesized
ucuuaccuaggguuaagcuuuaa

SEQ ID NO: 5823 - RNA, 23 nt, artificial
  Chemically synthesized
cuuaccuaggguuaagcuuuaau

SEQ ID NO: 5824 - RNA, 23 nt, artificial
  Chemically synthesized
uuaccuaggguuaagcuuuaauu

SEQ ID NO: 5825 - RNA, 23 nt, artificial
  Chemically synthesized
uucaucugagauuaagcacaugu

SEQ ID NO: 5826 - RNA, 23 nt, artificial
  Chemically synthesized
ucaucugagauuaagcacaugua

SEQ ID NO: 5827 - RNA, 23 nt, artificial
  Chemically synthesized
caucugagauuaagcacauguaa

SEQ ID NO: 5828 - RNA, 23 nt, artificial
  Chemically synthesized
aucugagauuaagcacauguaau

SEQ ID NO: 5829 - RNA, 23 nt, artificial
  Chemically synthesized
ucugagauuaagcacauguaaua

SEQ ID NO: 5830 - RNA, 23 nt, artificial
  Chemically synthesized
accaaauucuggcaaguugauuc

SEQ ID NO: 5831 - RNA, 23 nt, artificial
  Chemically synthesized
ccaaauucuggcaaguugauucc

SEQ ID NO: 5832 - RNA, 23 nt, artificial
  Chemically synthesized
caaauucuggcaaguugauuccu

SEQ ID NO: 5833 - RNA, 23 nt, artificial
  Chemically synthesized
aaauucuggcaaguugauuccuc

SEQ ID NO: 5834 - RNA, 23 nt, artificial
  Chemically synthesized
aauucuggcaaguugauuccuca

SEQ ID NO: 5835 - RNA, 23 nt, artificial
  Chemically synthesized
ucuuuaaaacauuagagugagga

SEQ ID NO: 5836 - RNA, 23 nt, artificial
  Chemically synthesized
cuuuaaaacauuagagugaggaa

SEQ ID NO: 5837 - RNA, 23 nt, artificial
  Chemically synthesized
uuuaaaacauuagagugaggaag

SEQ ID NO: 5838 - RNA, 23 nt, artificial
  Chemically synthesized
uuaaaacauuagagugaggaagu

SEQ ID NO: 5839 - RNA, 23 nt, artificial
  Chemically synthesized
uaaaacauuagagugaggaaguc

SEQ ID NO: 5840 - RNA, 23 nt, artificial
  Chemically synthesized
agauuggcuuuguaguaucuuuc

SEQ ID NO: 5841 - RNA, 23 nt, artificial
  Chemically synthesized
gauuggcuuuguaguaucuuucc

SEQ ID NO: 5842 - RNA, 23 nt, artificial
  Chemically synthesized
auuggcuuuguaguaucuuucca

SEQ ID NO: 5843 - RNA, 23 nt, artificial
  Chemically synthesized
uuggcuuuguaguaucuuuccaa

SEQ ID NO: 5844 - RNA, 23 nt, artificial
  Chemically synthesized
uaccuuccugucuaaaaacccuu

SEQ ID NO: 5845 - RNA, 23 nt, artificial
  Chemically synthesized
accuuccugucuaaaaacccuuc

SEQ ID NO: 5846 - RNA, 23 nt, artificial
  Chemically synthesized
ccuuccugucuaaaaacccuuca

SEQ ID NO: 5847 - RNA, 23 nt, artificial
  Chemically synthesized
cuuccugucuaaaaacccuucaa

SEQ ID NO: 5848 - RNA, 23 nt, artificial
  Chemically synthesized
uuccugucuaaaaacccuucaaa

SEQ ID NO: 5849 - RNA, 23 nt, artificial
  Chemically synthesized
uucaguaacaccaggaugaauac

SEQ ID NO: 5850 - RNA, 23 nt, artificial
  Chemically synthesized
ucacuuauaguaucaguaacagg

SEQ ID NO: 5851 - RNA, 23 nt, artificial
  Chemically synthesized
gcuguacuauaaaccauaucucc

SEQ ID NO: 5852 - RNA, 23 nt, artificial
  Chemically synthesized
cuguacuauaaaccauaucucca

SEQ ID NO: 5853 - RNA, 23 nt, artificial
  Chemically synthesized
uguacuauaaaccauaucuccau

SEQ ID NO: 5854 - RNA, 23 nt, artificial
  Chemically synthesized
guacuauaaaccauaucuccaua

SEQ ID NO: 5855 - RNA, 23 nt, artificial
  Chemically synthesized
uacuauaaaccauaucuccauag

SEQ ID NO: 5856 - RNA, 23 nt, artificial
  Chemically synthesized
ucuguacaaaaaugggaucuaug

SEQ ID NO: 5857 - RNA, 23 nt, artificial
  Chemically synthesized
cuguacaaaaaugggaucuaugc

SEQ ID NO: 5858 - RNA, 23 nt, artificial
  Chemically synthesized
uguacaaaaaugggaucuaugca

SEQ ID NO: 5859 - RNA, 23 nt, artificial
  Chemically synthesized
guacaaaaaugggaucuaugcag

SEQ ID NO: 5860 - RNA, 23 nt, artificial
  Chemically synthesized
uacaaaaaugggaucuaugcaga

SEQ ID NO: 5861 - RNA, 23 nt, artificial
  Chemically synthesized
accuauuccaucccauucaauuc

SEQ ID NO: 5862 - RNA, 23 nt, artificial
  Chemically synthesized
ccuauuccaucccauucaauucu

SEQ ID NO: 5863 - RNA, 23 nt, artificial
  Chemically synthesized
cuauuccaucccauucaauucug

SEQ ID NO: 5864 - RNA, 23 nt, artificial
  Chemically synthesized
uauuccaucccauucaauucugu

SEQ ID NO: 5865 - RNA, 23 nt, artificial
  Chemically synthesized
gaacuaauuuccuauccucacag

SEQ ID NO: 5866 - RNA, 23 nt, artificial
  Chemically synthesized
aacuaauuuccuauccucacagg

SEQ ID NO: 5867 - RNA, 23 nt, artificial
  Chemically synthesized
acuaauuuccuauccucacaggu

SEQ ID NO: 5868 - RNA, 23 nt, artificial
  Chemically synthesized
cuaauuuccuauccucacaggua

SEQ ID NO: 5869 - RNA, 23 nt, artificial
  Chemically synthesized
uaauuuccuauccucacagguau

SEQ ID NO: 5870 - RNA, 23 nt, artificial
  Chemically synthesized
ucucauuuacucuuaccuagggu

SEQ ID NO: 5871 - RNA, 23 nt, artificial
  Chemically synthesized
cucauuuacucuuaccuaggguu

SEQ ID NO: 5872 - RNA, 23 nt, artificial
  Chemically synthesized
ucauuuacucuuaccuaggguua

SEQ ID NO: 5873 - RNA, 23 nt, artificial
  Chemically synthesized
guaguaucuuuccaagcauuuga

SEQ ID NO: 5874 - RNA, 23 nt, artificial
  Chemically synthesized
uaguaucuuuccaagcauuugaa

SEQ ID NO: 5875 - RNA, 23 nt, artificial
  Chemically synthesized
aguaucuuuccaagcauuugaag

SEQ ID NO: 5876 - RNA, 23 nt, artificial
  Chemically synthesized
guaucuuuccaagcauuugaaga

SEQ ID NO: 5877 - RNA, 23 nt, artificial
  Chemically synthesized
uaucuuuccaagcauuugaagag

SEQ ID NO: 5878 - RNA, 23 nt, artificial
  Chemically synthesized
acacuauuuugaaucacuucucc

SEQ ID NO: 5879 - RNA, 23 nt, artificial
  Chemically synthesized
cacuauuuugaaucacuucucca

SEQ ID NO: 5880 - RNA, 23 nt, artificial
  Chemically synthesized
acuauuuugaaucacuucuccaa

SEQ ID NO: 5881 - RNA, 23 nt, artificial
  Chemically synthesized
cuauuuugaaucacuucuccaaa

SEQ ID NO: 5882 - RNA, 23 nt, artificial
  Chemically synthesized
uauuuugaaucacuucuccaaag

SEQ ID NO: 5883 - RNA, 23 nt, artificial
  Chemically synthesized
ccugaauaagcuccuuauccacg

SEQ ID NO: 5884 - RNA, 23 nt, artificial
  Chemically synthesized
cugaauaagcuccuuauccacga

SEQ ID NO: 5885 - RNA, 23 nt, artificial
  Chemically synthesized
ugaauaagcuccuuauccacgac

SEQ ID NO: 5886 - RNA, 23 nt, artificial
  Chemically synthesized
gaauaagcuccuuauccacgacc

SEQ ID NO: 5887 - RNA, 23 nt, artificial
  Chemically synthesized
aauaagcuccuuauccacgaccc

SEQ ID NO: 5888 - RNA, 23 nt, artificial
  Chemically synthesized
aaaaucaaaauaggcaaaucugg

SEQ ID NO: 5889 - RNA, 23 nt, artificial
  Chemically synthesized
aaaucaaaauaggcaaaucuggu

SEQ ID NO: 5890 - RNA, 23 nt, artificial
  Chemically synthesized
aaucaaaauaggcaaaucugguu

SEQ ID NO: 5891 - RNA, 23 nt, artificial
  Chemically synthesized
aucaaaauaggcaaaucugguuu

SEQ ID NO: 5892 - RNA, 23 nt, artificial
  Chemically synthesized
ucaaaauaggcaaaucugguuua

SEQ ID NO: 5893 - RNA, 23 nt, artificial
  Chemically synthesized
auuuugaaucacuucuccaaagg

SEQ ID NO: 5894 - RNA, 23 nt, artificial
  Chemically synthesized
uuuugaaucacuucuccaaaggc

SEQ ID NO: 5895 - RNA, 23 nt, artificial
  Chemically synthesized
auucuggcaaguugauuccucaa

SEQ ID NO: 5896 - RNA, 23 nt, artificial
  Chemically synthesized
uucuggcaaguugauuccucaaa

SEQ ID NO: 5897 - RNA, 23 nt, artificial
  Chemically synthesized
ucuggcaaguugauuccucaaau

SEQ ID NO: 5898 - RNA, 23 nt, artificial
  Chemically synthesized
ccauuauugccguaauauuucuc

SEQ ID NO: 5899 - RNA, 23 nt, artificial
  Chemically synthesized
cauuauugccguaauauuucuca

SEQ ID NO: 5900 - RNA, 23 nt, artificial
  Chemically synthesized
auuauugccguaauauuucucau

SEQ ID NO: 5901 - RNA, 23 nt, artificial
  Chemically synthesized
uuauugccguaauauuucucauu

SEQ ID NO: 5902 - RNA, 23 nt, artificial
  Chemically synthesized
uauugccguaauauuucucauuu

SEQ ID NO: 5903 - RNA, 23 nt, artificial
  Chemically synthesized
auuccaucccauucaauucugua

SEQ ID NO: 5904 - RNA, 23 nt, artificial
  Chemically synthesized
uuccaucccauucaauucuguac

SEQ ID NO: 5905 - RNA, 23 nt, artificial
  Chemically synthesized
cuacuuuugcuuaccuauuccau

SEQ ID NO: 5906 - RNA, 23 nt, artificial
  Chemically synthesized
cacaauccuauccagcuuuuuac

SEQ ID NO: 5907 - RNA, 23 nt, artificial
  Chemically synthesized
acaauccuauccagcuuuuuaca

SEQ ID NO: 5908 - RNA, 23 nt, artificial
  Chemically synthesized
caauccuauccagcuuuuuacau

SEQ ID NO: 5909 - RNA, 23 nt, artificial
  Chemically synthesized
aauccuauccagcuuuuuacaua

SEQ ID NO: 5910 - RNA, 23 nt, artificial
  Chemically synthesized
auccuauccagcuuuuuacauac

SEQ ID NO: 5911 - RNA, 23 nt, artificial
  Chemically synthesized
aaauuugagucaggaacuggugg

SEQ ID NO: 5912 - RNA, 23 nt, artificial
  Chemically synthesized
aauuugagucaggaacugguggu

SEQ ID NO: 5913 - RNA, 23 nt, artificial
  Chemically synthesized
auuugagucaggaacugguggug

SEQ ID NO: 5914 - RNA, 23 nt, artificial
  Chemically synthesized
uuugagucaggaacugguggugu

SEQ ID NO: 5915 - RNA, 23 nt, artificial
  Chemically synthesized
uugagucaggaacugguggugug

SEQ ID NO: 5916 - RNA, 23 nt, artificial
  Chemically synthesized
uuguuagaacacuggcuaauuug

SEQ ID NO: 5917 - RNA, 23 nt, artificial
  Chemically synthesized
uguuagaacacuggcuaauuuga

SEQ ID NO: 5918 - RNA, 23 nt, artificial
  Chemically synthesized
guuagaacacuggcuaauuugaa

SEQ ID NO: 5919 - RNA, 23 nt, artificial
  Chemically synthesized
uuagaacacuggcuaauuugaac

SEQ ID NO: 5920 - RNA, 23 nt, artificial
  Chemically synthesized
uagaacacuggcuaauuugaaca

SEQ ID NO: 5921 - RNA, 23 nt, artificial
  Chemically synthesized
ggguuucuuauuuagggcaggug

SEQ ID NO: 5922 - RNA, 23 nt, artificial
  Chemically synthesized
ucacuguuguuccaaucagugag

SEQ ID NO: 5923 - RNA, 23 nt, artificial
  Chemically synthesized
cacuguuguuccaaucagugagu

SEQ ID NO: 5924 - RNA, 23 nt, artificial
  Chemically synthesized
acuguuguuccaaucagugagua

SEQ ID NO: 5925 - RNA, 23 nt, artificial
  Chemically synthesized
cuguuguuccaaucagugaguaa

SEQ ID NO: 5926 - RNA, 23 nt, artificial
  Chemically synthesized
uguuguuccaaucagugaguaaa

SEQ ID NO: 5927 - RNA, 23 nt, artificial
  Chemically synthesized
uuggacagacaguucuccagcau

SEQ ID NO: 5928 - RNA, 23 nt, artificial
  Chemically synthesized
uuaucuuggcccaauucuauaaa

SEQ ID NO: 5929 - RNA, 23 nt, artificial
  Chemically synthesized
aucuuuccaagcauuugaagagu

SEQ ID NO: 5930 - RNA, 23 nt, artificial
  Chemically synthesized
ucuuuccaagcauuugaagaguu

SEQ ID NO: 5931 - RNA, 23 nt, artificial
  Chemically synthesized
cuuuccaagcauuugaagaguuu

SEQ ID NO: 5932 - RNA, 23 nt, artificial
  Chemically synthesized
uuuccaagcauuugaagaguuua

SEQ ID NO: 5933 - RNA, 23 nt, artificial
  Chemically synthesized
uuagagugaggaagucaccaaga

SEQ ID NO: 5934 - RNA, 23 nt, artificial
  Chemically synthesized
aagcuaguccaugagcaguucuc

SEQ ID NO: 5935 - RNA, 23 nt, artificial
  Chemically synthesized
agcuaguccaugagcaguucucc

SEQ ID NO: 5936 - RNA, 23 nt, artificial
  Chemically synthesized
gcuaguccaugagcaguucuccu

SEQ ID NO: 5937 - RNA, 23 nt, artificial
  Chemically synthesized
cuaguccaugagcaguucuccug

SEQ ID NO: 5938 - RNA, 23 nt, artificial
  Chemically synthesized
uaguccaugagcaguucuccugc

SEQ ID NO: 5939 - RNA, 23 nt, artificial
  Chemically synthesized
aagcuccuuauccacgacccaca

SEQ ID NO: 5940 - RNA, 23 nt, artificial
  Chemically synthesized
agcuccuuauccacgacccacag

SEQ ID NO: 5941 - RNA, 23 nt, artificial
  Chemically synthesized
gcuccuuauccacgacccacagc

SEQ ID NO: 5942 - RNA, 23 nt, artificial
  Chemically synthesized
ugaacagugacauuuuaggucac

SEQ ID NO: 5943 - RNA, 23 nt, artificial
  Chemically synthesized
gcaauucucugggucaguuucuc

SEQ ID NO: 5944 - RNA, 23 nt, artificial
  Chemically synthesized
caauucucugggucaguuucuca

SEQ ID NO: 5945 - RNA, 23 nt, artificial
  Chemically synthesized
aauucucugggucaguuucucag

SEQ ID NO: 5946 - RNA, 23 nt, artificial
  Chemically synthesized
auucucugggucaguuucucagg

SEQ ID NO: 5947 - RNA, 23 nt, artificial
  Chemically synthesized
uucucugggucaguuucucaggg

SEQ ID NO: 5948 - RNA, 23 nt, artificial
  Chemically synthesized
caaauuugagucaggaacuggug

SEQ ID NO: 5949 - RNA, 23 nt, artificial
  Chemically synthesized
uucucagggacaaggaccuuuga

SEQ ID NO: 5950 - RNA, 23 nt, artificial
  Chemically synthesized
ucucagggacaaggaccuuugag

SEQ ID NO: 5951 - RNA, 23 nt, artificial
  Chemically synthesized
cucagggacaaggaccuuugagc

SEQ ID NO: 5952 - RNA, 23 nt, artificial
  Chemically synthesized
ucagggacaaggaccuuugagca

SEQ ID NO: 5953 - RNA, 23 nt, artificial
  Chemically synthesized
uuuuuucuuaacaagucgaaauc

SEQ ID NO: 5954 - RNA, 23 nt, artificial
  Chemically synthesized
uuuuucuuaacaagucgaaaucc

SEQ ID NO: 5955 - RNA, 23 nt, artificial
  Chemically synthesized
uuuucuuaacaagucgaaauccu

SEQ ID NO: 5956 - RNA, 23 nt, artificial
  Chemically synthesized
cacagguauucaucauucacuca

SEQ ID NO: 5957 - RNA, 23 nt, artificial
  Chemically synthesized
acagguauucaucauucacucaa

SEQ ID NO: 5958 - RNA, 23 nt, artificial
  Chemically synthesized
cagguauucaucauucacucaau

SEQ ID NO: 5959 - RNA, 23 nt, artificial
  Chemically synthesized
agguauucaucauucacucaaug

SEQ ID NO: 5960 - RNA, 23 nt, artificial
  Chemically synthesized
acagugaagcaguuccauuauug

SEQ ID NO: 5961 - RNA, 23 nt, artificial
  Chemically synthesized
cagugaagcaguuccauuauugc

SEQ ID NO: 5962 - RNA, 23 nt, artificial
  Chemically synthesized
agugaagcaguuccauuauugcc

SEQ ID NO: 5963 - RNA, 23 nt, artificial
  Chemically synthesized
gugaagcaguuccauuauugccg

SEQ ID NO: 5964 - RNA, 23 nt, artificial
  Chemically synthesized
ugaagcaguuccauuauugccgu

SEQ ID NO: 5965 - RNA, 23 nt, artificial
  Chemically synthesized
agagucaaagauaacuguuagug

SEQ ID NO: 5966 - RNA, 23 nt, artificial
  Chemically synthesized
gagucaaagauaacuguuagugg

SEQ ID NO: 5967 - RNA, 23 nt, artificial
  Chemically synthesized
agucaaagauaacuguuagugga

SEQ ID NO: 5968 - RNA, 23 nt, artificial
  Chemically synthesized
gucaaagauaacuguuaguggaa

SEQ ID NO: 5969 - RNA, 23 nt, artificial
  Chemically synthesized
ucaaagauaacuguuaguggaaa

SEQ ID NO: 5970 - RNA, 23 nt, artificial
  Chemically synthesized
aagcucaaaaguagguacgacgc

SEQ ID NO: 5971 - RNA, 23 nt, artificial
  Chemically synthesized
agcucaaaaguagguacgacgcu

SEQ ID NO: 5972 - RNA, 23 nt, artificial
  Chemically synthesized
gcucaaaaguagguacgacgcua

SEQ ID NO: 5973 - RNA, 23 nt, artificial
  Chemically synthesized
cucaaaaguagguacgacgcuag

SEQ ID NO: 5974 - RNA, 23 nt, artificial
  Chemically synthesized
ucaaaaguagguacgacgcuaga

SEQ ID NO: 5975 - RNA, 23 nt, artificial
  Chemically synthesized
cagcaauucugaaaugcuggccg

SEQ ID NO: 5976 - RNA, 23 nt, artificial
  Chemically synthesized
agcaauucugaaaugcuggccgg

SEQ ID NO: 5977 - RNA, 23 nt, artificial
  Chemically synthesized
gcaauucugaaaugcuggccggg

SEQ ID NO: 5978 - RNA, 23 nt, artificial
  Chemically synthesized
caauucugaaaugcuggccgggu

SEQ ID NO: 5979 - RNA, 23 nt, artificial
  Chemically synthesized
aauucugaaaugcuggccggguu

SEQ ID NO: 5980 - RNA, 23 nt, artificial
  Chemically synthesized
augguucaucugagauuaagcac

SEQ ID NO: 5981 - RNA, 23 nt, artificial
  Chemically synthesized
ugguucaucugagauuaagcaca

SEQ ID NO: 5982 - RNA, 23 nt, artificial
  Chemically synthesized
gguucaucugagauuaagcacau

SEQ ID NO: 5983 - RNA, 23 nt, artificial
  Chemically synthesized
guucaucugagauuaagcacaug

SEQ ID NO: 5984 - RNA, 23 nt, artificial
  Chemically synthesized
cuucuacuuuugcuuaccuauuc

SEQ ID NO: 5985 - RNA, 23 nt, artificial
  Chemically synthesized
uucuacuuuugcuuaccuauucc

SEQ ID NO: 5986 - RNA, 23 nt, artificial
  Chemically synthesized
ucuacuuuugcuuaccuauucca

SEQ ID NO: 5987 - RNA, 23 nt, artificial
  Chemically synthesized
caaguucacgugcauaacacaac

SEQ ID NO: 5988 - RNA, 23 nt, artificial
  Chemically synthesized
aaguucacgugcauaacacaacc

SEQ ID NO: 5989 - RNA, 23 nt, artificial
  Chemically synthesized
aguucacgugcauaacacaaccu

SEQ ID NO: 5990 - RNA, 23 nt, artificial
  Chemically synthesized
guucacgugcauaacacaaccuc

SEQ ID NO: 5991 - RNA, 23 nt, artificial
  Chemically synthesized
uucacgugcauaacacaaccucg

SEQ ID NO: 5992 - RNA, 23 nt, artificial
  Chemically synthesized
aguuucauucucuaggcuguacu

SEQ ID NO: 5993 - RNA, 23 nt, artificial
  Chemically synthesized
guuucauucucuaggcuguacua

SEQ ID NO: 5994 - RNA, 23 nt, artificial
  Chemically synthesized
uuucauucucuaggcuguacuau

SEQ ID NO: 5995 - RNA, 23 nt, artificial
  Chemically synthesized
uucauucucuaggcuguacuaua

SEQ ID NO: 5996 - RNA, 23 nt, artificial
  Chemically synthesized
ucauucucuaggcuguacuauaa

SEQ ID NO: 5997 - RNA, 23 nt, artificial
  Chemically synthesized
uugcuuugauuuggacagacagu

SEQ ID NO: 5998 - RNA, 23 nt, artificial
  Chemically synthesized
cugcuuaaacacaaguguaagcu

SEQ ID NO: 5999 - RNA, 23 nt, artificial
  Chemically synthesized
ugcuuaaacacaaguguaagcuc

SEQ ID NO: 6000 - RNA, 23 nt, artificial
  Chemically synthesized
gcuuaaacacaaguguaagcuca

SEQ ID NO: 6001 - RNA, 23 nt, artificial
  Chemically synthesized
cuuaaacacaaguguaagcucaa

SEQ ID NO: 6002 - RNA, 23 nt, artificial
  Chemically synthesized
uuaaacacaaguguaagcucaaa

SEQ ID NO: 6003 - RNA, 23 nt, artificial
  Chemically synthesized
cugaauaguuuuacuacccaauc

SEQ ID NO: 6004 - RNA, 23 nt, artificial
  Chemically synthesized
ugaauaguuuuacuacccaauca

SEQ ID NO: 6005 - RNA, 23 nt, artificial
  Chemically synthesized
gaauaguuuuacuacccaaucau

SEQ ID NO: 6006 - RNA, 23 nt, artificial
  Chemically synthesized
aauaguuuuacuacccaaucaug

SEQ ID NO: 6007 - RNA, 23 nt, artificial
  Chemically synthesized
acauuuucaauuuccaaguucac

SEQ ID NO: 6008 - RNA, 23 nt, artificial
  Chemically synthesized
cagcauuuuaaccaaauucuggc

SEQ ID NO: 6009 - RNA, 23 nt, artificial
  Chemically synthesized
agcauuuuaaccaaauucuggca

SEQ ID NO: 6010 - RNA, 23 nt, artificial
  Chemically synthesized
gcauuuuaaccaaauucuggcaa

SEQ ID NO: 6011 - RNA, 23 nt, artificial
  Chemically synthesized
cauuuuaaccaaauucuggcaag

SEQ ID NO: 6012 - RNA, 23 nt, artificial
  Chemically synthesized
auuuuaaccaaauucuggcaagu

SEQ ID NO: 6013 - RNA, 23 nt, artificial
  Chemically synthesized
ucuugcugcucaaacugccaguu

SEQ ID NO: 6014 - RNA, 23 nt, artificial
  Chemically synthesized
cuugcugcucaaacugccaguug

SEQ ID NO: 6015 - RNA, 23 nt, artificial
  Chemically synthesized
uugcugcucaaacugccaguugc

SEQ ID NO: 6016 - RNA, 23 nt, artificial
  Chemically synthesized
ggccuuuauuauucccuagugac

SEQ ID NO: 6017 - RNA, 23 nt, artificial
  Chemically synthesized
gccuuuauuauucccuagugaca

SEQ ID NO: 6018 - RNA, 23 nt, artificial
  Chemically synthesized
ugaaucagagagggacuagaucu

SEQ ID NO: 6019 - RNA, 23 nt, artificial
  Chemically synthesized
gaaucagagagggacuagaucuc

SEQ ID NO: 6020 - RNA, 23 nt, artificial
  Chemically synthesized
aaucagagagggacuagaucuca

SEQ ID NO: 6021 - RNA, 23 nt, artificial
  Chemically synthesized
aucagagagggacuagaucucag

SEQ ID NO: 6022 - RNA, 23 nt, artificial
  Chemically synthesized
ucagagagggacuagaucucaga

SEQ ID NO: 6023 - RNA, 23 nt, artificial
  Chemically synthesized
ucuacaucgaugcccaagaagcc

SEQ ID NO: 6024 - RNA, 23 nt, artificial
  Chemically synthesized
ggacaucuugagcaauucucugg

SEQ ID NO: 6025 - RNA, 23 nt, artificial
  Chemically synthesized
gacaucuugagcaauucucuggg

SEQ ID NO: 6026 - RNA, 23 nt, artificial
  Chemically synthesized
acaucuugagcaauucucugggu

SEQ ID NO: 6027 - RNA, 23 nt, artificial
  Chemically synthesized
caucuugagcaauucucuggguc

SEQ ID NO: 6028 - RNA, 23 nt, artificial
  Chemically synthesized
aucuugagcaauucucuggguca

SEQ ID NO: 6029 - RNA, 23 nt, artificial
  Chemically synthesized
guauucaacacuuaagaacaggg

SEQ ID NO: 6030 - RNA, 23 nt, artificial
  Chemically synthesized
uauucaacacuuaagaacagggg

SEQ ID NO: 6031 - RNA, 23 nt, artificial
  Chemically synthesized
auucaacacuuaagaacagggga

SEQ ID NO: 6032 - RNA, 23 nt, artificial
  Chemically synthesized
uucaacacuuaagaacaggggaa

SEQ ID NO: 6033 - RNA, 23 nt, artificial
  Chemically synthesized
ucaacacuuaagaacaggggaaa

SEQ ID NO: 6034 - RNA, 23 nt, artificial
  Chemically synthesized
ucuugagcaauucucugggucag

SEQ ID NO: 6035 - RNA, 23 nt, artificial
  Chemically synthesized
cuugagcaauucucugggucagu

SEQ ID NO: 6036 - RNA, 23 nt, artificial
  Chemically synthesized
uugagcaauucucugggucaguu

SEQ ID NO: 6037 - RNA, 23 nt, artificial
  Chemically synthesized
uuugaaucacuucuccaaaggcc

SEQ ID NO: 6038 - RNA, 23 nt, artificial
  Chemically synthesized
gagaugagauaacacugccaugg

SEQ ID NO: 6039 - RNA, 23 nt, artificial
  Chemically synthesized
agaugagauaacacugccauggu

SEQ ID NO: 6040 - RNA, 23 nt, artificial
  Chemically synthesized
gaugagauaacacugccauggug

SEQ ID NO: 6041 - RNA, 23 nt, artificial
  Chemically synthesized
augagauaacacugccaugguga

SEQ ID NO: 6042 - RNA, 23 nt, artificial
  Chemically synthesized
ugagauaacacugccauggugaa

SEQ ID NO: 6043 - RNA, 23 nt, artificial
  Chemically synthesized
uaacaagucgaaauccugagcug

SEQ ID NO: 6044 - RNA, 23 nt, artificial
  Chemically synthesized
cuacuuaauccuaccuuccuguc

SEQ ID NO: 6045 - RNA, 23 nt, artificial
  Chemically synthesized
uacuuaauccuaccuuccugucu

SEQ ID NO: 6046 - RNA, 23 nt, artificial
  Chemically synthesized
acuuaauccuaccuuccugucua

SEQ ID NO: 6047 - RNA, 23 nt, artificial
  Chemically synthesized
cuuaauccuaccuuccugucuaa

SEQ ID NO: 6048 - RNA, 23 nt, artificial
  Chemically synthesized
uuaauccuaccuuccugucuaaa

SEQ ID NO: 6049 - RNA, 23 nt, artificial
  Chemically synthesized
uauauuuucccuuuuuaggaccc

SEQ ID NO: 6050 - RNA, 23 nt, artificial
  Chemically synthesized
auauuuucccuuuuuaggacccu

SEQ ID NO: 6051 - RNA, 23 nt, artificial
  Chemically synthesized
uauuuucccuuuuuaggacccuu

SEQ ID NO: 6052 - RNA, 23 nt, artificial
  Chemically synthesized
aaaccugaauaagcuccuuaucc

SEQ ID NO: 6053 - RNA, 23 nt, artificial
  Chemically synthesized
aaccugaauaagcuccuuaucca

SEQ ID NO: 6054 - RNA, 23 nt, artificial
  Chemically synthesized
accugaauaagcuccuuauccac

SEQ ID NO: 6055 - RNA, 23 nt, artificial
  Chemically synthesized
uuaauuuaacagccuuccauaag

SEQ ID NO: 6056 - RNA, 23 nt, artificial
  Chemically synthesized
ggucaacggcucuguuuccuucg

SEQ ID NO: 6057 - RNA, 23 nt, artificial
  Chemically synthesized
gucaacggcucuguuuccuucgc

SEQ ID NO: 6058 - RNA, 23 nt, artificial
  Chemically synthesized
ucaacggcucuguuuccuucgcg

SEQ ID NO: 6059 - RNA, 23 nt, artificial
  Chemically synthesized
caacggcucuguuuccuucgcga

SEQ ID NO: 6060 - RNA, 23 nt, artificial
  Chemically synthesized
aacggcucuguuuccuucgcgag

SEQ ID NO: 6061 - RNA, 23 nt, artificial
  Chemically synthesized
ugaagaguuuaguuuguuagaac

SEQ ID NO: 6062 - RNA, 23 nt, artificial
  Chemically synthesized
gaagaguuuaguuuguuagaaca

SEQ ID NO: 6063 - RNA, 23 nt, artificial
  Chemically synthesized
aguauucaacacuuaagaacagg

SEQ ID NO: 6064 - RNA, 23 nt, artificial
  Chemically synthesized
ggaauaagacaaaaaauaaggcc

SEQ ID NO: 6065 - RNA, 23 nt, artificial
  Chemically synthesized
gaauaagacaaaaaauaaggccu

SEQ ID NO: 6066 - RNA, 23 nt, artificial
  Chemically synthesized
aauaagacaaaaaauaaggccuu

SEQ ID NO: 6067 - RNA, 23 nt, artificial
  Chemically synthesized
auaagacaaaaaauaaggccuuu

SEQ ID NO: 6068 - RNA, 23 nt, artificial
  Chemically synthesized
uaagacaaaaaauaaggccuuua

SEQ ID NO: 6069 - RNA, 23 nt, artificial
  Chemically synthesized
agauuacuaagugaaucagagag

SEQ ID NO: 6070 - RNA, 23 nt, artificial
  Chemically synthesized
gauuacuaagugaaucagagagg

SEQ ID NO: 6071 - RNA, 23 nt, artificial
  Chemically synthesized
auuacuaagugaaucagagaggg

SEQ ID NO: 6072 - RNA, 23 nt, artificial
  Chemically synthesized
uuacuaagugaaucagagaggga

SEQ ID NO: 6073 - RNA, 23 nt, artificial
  Chemically synthesized
uacuaagugaaucagagagggac

SEQ ID NO: 6074 - RNA, 23 nt, artificial
  Chemically synthesized
ggacaacaguucuacaucgaugc

SEQ ID NO: 6075 - RNA, 23 nt, artificial
  Chemically synthesized
gacaacaguucuacaucgaugcc

SEQ ID NO: 6076 - RNA, 23 nt, artificial
  Chemically synthesized
acaacaguucuacaucgaugccc

SEQ ID NO: 6077 - RNA, 23 nt, artificial
  Chemically synthesized
caacaguucuacaucgaugccca

SEQ ID NO: 6078 - RNA, 23 nt, artificial
  Chemically synthesized
aacaguucuacaucgaugcccaa

SEQ ID NO: 6079 - RNA, 23 nt, artificial
  Chemically synthesized
uaagcucaaaaguagguacgacg

SEQ ID NO: 6080 - RNA, 23 nt, artificial
  Chemically synthesized
uaucuggacggugaguuucauuc

SEQ ID NO: 6081 - RNA, 23 nt, artificial
  Chemically synthesized
aucuggacggugaguuucauucu

SEQ ID NO: 6082 - RNA, 23 nt, artificial
  Chemically synthesized
ucuggacggugaguuucauucuc

SEQ ID NO: 6083 - RNA, 23 nt, artificial
  Chemically synthesized
cuggacggugaguuucauucucu

SEQ ID NO: 6084 - RNA, 23 nt, artificial
  Chemically synthesized
uggacggugaguuucauucucua

SEQ ID NO: 6085 - RNA, 23 nt, artificial
  Chemically synthesized
accuuuggagcuuaacaauagac

SEQ ID NO: 6086 - RNA, 23 nt, artificial
  Chemically synthesized
ccuuuggagcuuaacaauagaca

SEQ ID NO: 6087 - RNA, 23 nt, artificial
  Chemically synthesized
cuuuggagcuuaacaauagacau

SEQ ID NO: 6088 - RNA, 23 nt, artificial
  Chemically synthesized
uuuggagcuuaacaauagacaug

SEQ ID NO: 6089 - RNA, 23 nt, artificial
  Chemically synthesized
uuggagcuuaacaauagacaugc

SEQ ID NO: 6090 - RNA, 23 nt, artificial
  Chemically synthesized
caaauauuaccucguugagguug

SEQ ID NO: 6091 - RNA, 23 nt, artificial
  Chemically synthesized
aaauauuaccucguugagguugg

SEQ ID NO: 6092 - RNA, 23 nt, artificial
  Chemically synthesized
aauauuaccucguugagguuggg

SEQ ID NO: 6093 - RNA, 23 nt, artificial
  Chemically synthesized
auauuaccucguugagguugggu

SEQ ID NO: 6094 - RNA, 23 nt, artificial
  Chemically synthesized
uauuaccucguugagguuggguu

SEQ ID NO: 6095 - RNA, 23 nt, artificial
  Chemically synthesized
acaacauugauuuaucuuggccc

SEQ ID NO: 6096 - RNA, 23 nt, artificial
  Chemically synthesized
caacauugauuuaucuuggccca

SEQ ID NO: 6097 - RNA, 23 nt, artificial
  Chemically synthesized
aacauugauuuaucuuggcccaa

SEQ ID NO: 6098 - RNA, 23 nt, artificial
  Chemically synthesized
acauugauuuaucuuggcccaau

SEQ ID NO: 6099 - RNA, 23 nt, artificial
  Chemically synthesized
cauugauuuaucuuggcccaauu

SEQ ID NO: 6100 - RNA, 23 nt, artificial
  Chemically synthesized
uauagucuauuaccaagccuacc

SEQ ID NO: 6101 - RNA, 23 nt, artificial
  Chemically synthesized
aaguugauuccucaaauauuacc

SEQ ID NO: 6102 - RNA, 23 nt, artificial
  Chemically synthesized
aguugauuccucaaauauuaccu

SEQ ID NO: 6103 - RNA, 23 nt, artificial
  Chemically synthesized
guugauuccucaaauauuaccuc

SEQ ID NO: 6104 - RNA, 23 nt, artificial
  Chemically synthesized
uccuauccagcuuuuuacauaca

SEQ ID NO: 6105 - RNA, 23 nt, artificial
  Chemically synthesized
ccuauccagcuuuuuacauacau

SEQ ID NO: 6106 - RNA, 23 nt, artificial
  Chemically synthesized
cuauccagcuuuuuacauacauu

SEQ ID NO: 6107 - RNA, 23 nt, artificial
  Chemically synthesized
uauccagcuuuuuacauacauuu

SEQ ID NO: 6108 - RNA, 23 nt, artificial
  Chemically synthesized
gacuucguaaauugacccguuuc

SEQ ID NO: 6109 - RNA, 23 nt, artificial
  Chemically synthesized
acuucguaaauugacccguuuca

SEQ ID NO: 6110 - RNA, 23 nt, artificial
  Chemically synthesized
cuucguaaauugacccguuucaa

SEQ ID NO: 6111 - RNA, 23 nt, artificial
  Chemically synthesized
uucguaaauugacccguuucaau

SEQ ID NO: 6112 - RNA, 23 nt, artificial
  Chemically synthesized
ucguaaauugacccguuucaaua

SEQ ID NO: 6113 - RNA, 23 nt, artificial
  Chemically synthesized
cugcucaaacugccaguugcaac

SEQ ID NO: 6114 - RNA, 23 nt, artificial
  Chemically synthesized
ugcucaaacugccaguugcaacc

SEQ ID NO: 6115 - RNA, 23 nt, artificial
  Chemically synthesized
gcucaaacugccaguugcaacca

SEQ ID NO: 6116 - RNA, 23 nt, artificial
  Chemically synthesized
cucaaacugccaguugcaaccau

SEQ ID NO: 6117 - RNA, 23 nt, artificial
  Chemically synthesized
ucaaacugccaguugcaaccaug

SEQ ID NO: 6118 - RNA, 23 nt, artificial
  Chemically synthesized
gacggugaguuucauucucuagg

SEQ ID NO: 6119 - RNA, 23 nt, artificial
  Chemically synthesized
acggugaguuucauucucuaggc

SEQ ID NO: 6120 - RNA, 23 nt, artificial
  Chemically synthesized
cggugaguuucauucucuaggcu

SEQ ID NO: 6121 - RNA, 23 nt, artificial
  Chemically synthesized
ggugaguuucauucucuaggcug

SEQ ID NO: 6122 - RNA, 23 nt, artificial
  Chemically synthesized
gugaguuucauucucuaggcugu

SEQ ID NO: 6123 - RNA, 23 nt, artificial
  Chemically synthesized
guagucaaaaucacuuagcaggc

SEQ ID NO: 6124 - RNA, 23 nt, artificial
  Chemically synthesized
uagucaaaaucacuuagcaggcu

SEQ ID NO: 6125 - RNA, 23 nt, artificial
  Chemically synthesized
agucaaaaucacuuagcaggcuc

SEQ ID NO: 6126 - RNA, 23 nt, artificial
  Chemically synthesized
gucaaaaucacuuagcaggcucu

SEQ ID NO: 6127 - RNA, 23 nt, artificial
  Chemically synthesized
ucaaaaucacuuagcaggcucuc

SEQ ID NO: 6128 - RNA, 23 nt, artificial
  Chemically synthesized
agcaugugaaguggagcuaauag

SEQ ID NO: 6129 - RNA, 23 nt, artificial
  Chemically synthesized
gcaugugaaguggagcuaauagc

SEQ ID NO: 6130 - RNA, 23 nt, artificial
  Chemically synthesized
caugugaaguggagcuaauagcu

SEQ ID NO: 6131 - RNA, 23 nt, artificial
  Chemically synthesized
augugaaguggagcuaauagcua

SEQ ID NO: 6132 - RNA, 23 nt, artificial
  Chemically synthesized
ugugaaguggagcuaauagcuag

SEQ ID NO: 6133 - RNA, 23 nt, artificial
  Chemically synthesized
uuaggacccuucaaucacuguug

SEQ ID NO: 6134 - RNA, 23 nt, artificial
  Chemically synthesized
gugguaguauacagcuacuaccc

SEQ ID NO: 6135 - RNA, 23 nt, artificial
  Chemically synthesized
ugguaguauacagcuacuacccu

SEQ ID NO: 6136 - RNA, 23 nt, artificial
  Chemically synthesized
gguaguauacagcuacuacccuu

SEQ ID NO: 6137 - RNA, 23 nt, artificial
  Chemically synthesized
aauuaaacucaccuacuuaaucc

SEQ ID NO: 6138 - RNA, 23 nt, artificial
  Chemically synthesized
auuaaacucaccuacuuaauccu

SEQ ID NO: 6139 - RNA, 23 nt, artificial
  Chemically synthesized
uuaaacucaccuacuuaauccua

SEQ ID NO: 6140 - RNA, 23 nt, artificial
  Chemically synthesized
uaaacucaccuacuuaauccuac

SEQ ID NO: 6141 - RNA, 23 nt, artificial
  Chemically synthesized
aaacucaccuacuuaauccuacc

SEQ ID NO: 6142 - RNA, 23 nt, artificial
  Chemically synthesized
aacaauagacaugcaaaacaaca

SEQ ID NO: 6143 - RNA, 23 nt, artificial
  Chemically synthesized
acaauagacaugcaaaacaacau

SEQ ID NO: 6144 - RNA, 23 nt, artificial
  Chemically synthesized
caauagacaugcaaaacaacauu

SEQ ID NO: 6145 - RNA, 23 nt, artificial
  Chemically synthesized
aauagacaugcaaaacaacauug

SEQ ID NO: 6146 - RNA, 23 nt, artificial
  Chemically synthesized
auagacaugcaaaacaacauuga

SEQ ID NO: 6147 - RNA, 23 nt, artificial
  Chemically synthesized
cccuucaaauuugagucaggaac

SEQ ID NO: 6148 - RNA, 23 nt, artificial
  Chemically synthesized
ccuucaaauuugagucaggaacu

SEQ ID NO: 6149 - RNA, 23 nt, artificial
  Chemically synthesized
cuucaaauuugagucaggaacug

SEQ ID NO: 6150 - RNA, 23 nt, artificial
  Chemically synthesized
uucaaauuugagucaggaacugg

SEQ ID NO: 6151 - RNA, 23 nt, artificial
  Chemically synthesized
ucaaauuugagucaggaacuggu

SEQ ID NO: 6152 - RNA, 23 nt, artificial
  Chemically synthesized
ucuaaaacaacaccgugguuacu

SEQ ID NO: 6153 - RNA, 23 nt, artificial
  Chemically synthesized
cuaaaacaacaccgugguuacug

SEQ ID NO: 6154 - RNA, 23 nt, artificial
  Chemically synthesized
uaaaacaacaccgugguuacuga

SEQ ID NO: 6155 - RNA, 23 nt, artificial
  Chemically synthesized
aaaacaacaccgugguuacugaa

SEQ ID NO: 6156 - RNA, 23 nt, artificial
  Chemically synthesized
aaacaacaccgugguuacugaaa

SEQ ID NO: 6157 - RNA, 23 nt, artificial
  Chemically synthesized
aacaacaccgugguuacugaaau

SEQ ID NO: 6158 - RNA, 23 nt, artificial
  Chemically synthesized
gguauccaagguggaaaaaaucu

SEQ ID NO: 6159 - RNA, 23 nt, artificial
  Chemically synthesized
guauccaagguggaaaaaaucug

SEQ ID NO: 6160 - RNA, 23 nt, artificial
  Chemically synthesized
uauccaagguggaaaaaaucugg

SEQ ID NO: 6161 - RNA, 23 nt, artificial
  Chemically synthesized
auccaagguggaaaaaaucuggg

SEQ ID NO: 6162 - RNA, 23 nt, artificial
  Chemically synthesized
uccaagguggaaaaaaucugggu

SEQ ID NO: 6163 - RNA, 23 nt, artificial
  Chemically synthesized
gaaaaucaaaauaggcaaaucug

SEQ ID NO: 6164 - RNA, 23 nt, artificial
  Chemically synthesized
cauucucuaggcuguacuauaaa

SEQ ID NO: 6165 - RNA, 23 nt, artificial
  Chemically synthesized
auucucuaggcuguacuauaaac

SEQ ID NO: 6166 - RNA, 23 nt, artificial
  Chemically synthesized
uucucuaggcuguacuauaaacc

SEQ ID NO: 6167 - RNA, 23 nt, artificial
  Chemically synthesized
ucacgugcauaacacaaccucgc

SEQ ID NO: 6168 - RNA, 23 nt, artificial
  Chemically synthesized
auuauucccuagugacagguauc

SEQ ID NO: 6169 - RNA, 23 nt, artificial
  Chemically synthesized
uuauucccuagugacagguaucc

SEQ ID NO: 6170 - RNA, 23 nt, artificial
  Chemically synthesized
uauucccuagugacagguaucca

SEQ ID NO: 6171 - RNA, 23 nt, artificial
  Chemically synthesized
auucccuagugacagguauccaa

SEQ ID NO: 6172 - RNA, 23 nt, artificial
  Chemically synthesized
uucccuagugacagguauccaag

SEQ ID NO: 6173 - RNA, 23 nt, artificial
  Chemically synthesized
auugccguaauauuucucauuua

SEQ ID NO: 6174 - RNA, 23 nt, artificial
  Chemically synthesized
gggcuuuuggaaguuuugauagg

SEQ ID NO: 6175 - RNA, 23 nt, artificial
  Chemically synthesized
gaugaauacaucugucccuacgc

SEQ ID NO: 6176 - RNA, 23 nt, artificial
  Chemically synthesized
augaauacaucugucccuacgcc

SEQ ID NO: 6177 - RNA, 23 nt, artificial
  Chemically synthesized
ugaauacaucugucccuacgccg

SEQ ID NO: 6178 - RNA, 23 nt, artificial
  Chemically synthesized
gaauacaucugucccuacgccgg

SEQ ID NO: 6179 - RNA, 23 nt, artificial
  Chemically synthesized
aauacaucugucccuacgccggu

SEQ ID NO: 6180 - RNA, 23 nt, artificial
  Chemically synthesized
cauuuuaggucacuuauaguauc

SEQ ID NO: 6181 - RNA, 23 nt, artificial
  Chemically synthesized
auuuuaggucacuuauaguauca

SEQ ID NO: 6182 - RNA, 23 nt, artificial
  Chemically synthesized
uuuuaggucacuuauaguaucag

SEQ ID NO: 6183 - RNA, 23 nt, artificial
  Chemically synthesized
uuuaggucacuuauaguaucagu

SEQ ID NO: 6184 - RNA, 23 nt, artificial
  Chemically synthesized
uuaggucacuuauaguaucagua

SEQ ID NO: 6185 - RNA, 23 nt, artificial
  Chemically synthesized
cuccauagccaaugcagacuucg

SEQ ID NO: 6186 - RNA, 23 nt, artificial
  Chemically synthesized
uccauagccaaugcagacuucgu

SEQ ID NO: 6187 - RNA, 23 nt, artificial
  Chemically synthesized
ccauagccaaugcagacuucgua

SEQ ID NO: 6188 - RNA, 23 nt, artificial
  Chemically synthesized
cauagccaaugcagacuucguaa

SEQ ID NO: 6189 - RNA, 23 nt, artificial
  Chemically synthesized
auagccaaugcagacuucguaaa

SEQ ID NO: 6190 - RNA, 23 nt, artificial
  Chemically synthesized
uagaaucacacacaauccuaucc

SEQ ID NO: 6191 - RNA, 23 nt, artificial
  Chemically synthesized
agaaucacacacaauccuaucca

SEQ ID NO: 6192 - RNA, 23 nt, artificial
  Chemically synthesized
gaaucacacacaauccuauccag

SEQ ID NO: 6193 - RNA, 23 nt, artificial
  Chemically synthesized
aaucacacacaauccuauccagc

SEQ ID NO: 6194 - RNA, 23 nt, artificial
  Chemically synthesized
aucacacacaauccuauccagcu

SEQ ID NO: 6195 - RNA, 23 nt, artificial
  Chemically synthesized
uugaaucacuucuccaaaggcca

SEQ ID NO: 6196 - RNA, 23 nt, artificial
  Chemically synthesized
ugaaucacuucuccaaaggccag

SEQ ID NO: 6197 - RNA, 23 nt, artificial
  Chemically synthesized
gaaucacuucuccaaaggccaga

SEQ ID NO: 6198 - RNA, 23 nt, artificial
  Chemically synthesized
aaucacuucuccaaaggccagaa

SEQ ID NO: 6199 - RNA, 23 nt, artificial
  Chemically synthesized
ggcuucuacuuuugcuuaccuau

SEQ ID NO: 6200 - RNA, 23 nt, artificial
  Chemically synthesized
gcuucuacuuuugcuuaccuauu

SEQ ID NO: 6201 - RNA, 23 nt, artificial
  Chemically synthesized
aacucaccuacuuaauccuaccu

SEQ ID NO: 6202 - RNA, 23 nt, artificial
  Chemically synthesized
acucaccuacuuaauccuaccuu

SEQ ID NO: 6203 - RNA, 23 nt, artificial
  Chemically synthesized
cucaccuacuuaauccuaccuuc

SEQ ID NO: 6204 - RNA, 23 nt, artificial
  Chemically synthesized
ucaccuacuuaauccuaccuucc

SEQ ID NO: 6205 - RNA, 23 nt, artificial
  Chemically synthesized
uaauuaaacucaccuacuuaauc

SEQ ID NO: 6206 - RNA, 23 nt, artificial
  Chemically synthesized
caccuacuuaauccuaccuuccu

SEQ ID NO: 6207 - RNA, 23 nt, artificial
  Chemically synthesized
accuacuuaauccuaccuuccug

SEQ ID NO: 6208 - RNA, 23 nt, artificial
  Chemically synthesized
ccuacuuaauccuaccuuccugu

SEQ ID NO: 6209 - RNA, 23 nt, artificial
  Chemically synthesized
ucaguaacaggaucacaccuguu

SEQ ID NO: 6210 - RNA, 23 nt, artificial
  Chemically synthesized
aaagucccugaagcuaguccaug

SEQ ID NO: 6211 - RNA, 23 nt, artificial
  Chemically synthesized
aagucccugaagcuaguccauga

SEQ ID NO: 6212 - RNA, 23 nt, artificial
  Chemically synthesized
agucccugaagcuaguccaugag

SEQ ID NO: 6213 - RNA, 23 nt, artificial
  Chemically synthesized
gucccugaagcuaguccaugagc

SEQ ID NO: 6214 - RNA, 23 nt, artificial
  Chemically synthesized
ucccugaagcuaguccaugagca

SEQ ID NO: 6215 - RNA, 23 nt, artificial
  Chemically synthesized
uccugucuaaaaacccuucaaau

SEQ ID NO: 6216 - RNA, 23 nt, artificial
  Chemically synthesized
uaggacccuucaaucacuguugu

SEQ ID NO: 6217 - RNA, 23 nt, artificial
  Chemically synthesized
uccaucccauucaauucuguaca

SEQ ID NO: 6218 - RNA, 23 nt, artificial
  Chemically synthesized
ccaucccauucaauucuguacaa

SEQ ID NO: 6219 - RNA, 23 nt, artificial
  Chemically synthesized
caucccauucaauucuguacaaa

SEQ ID NO: 6220 - RNA, 23 nt, artificial
  Chemically synthesized
aucccauucaauucuguacaaaa

SEQ ID NO: 6221 - RNA, 23 nt, artificial
  Chemically synthesized
ucccauucaauucuguacaaaaa

SEQ ID NO: 6222 - RNA, 23 nt, artificial
  Chemically synthesized
uccucaaauauuaccucguugag

SEQ ID NO: 6223 - RNA, 23 nt, artificial
  Chemically synthesized
ccucaaauauuaccucguugagg

SEQ ID NO: 6224 - RNA, 23 nt, artificial
  Chemically synthesized
cucaaauauuaccucguugaggu

SEQ ID NO: 6225 - RNA, 23 nt, artificial
  Chemically synthesized
ucaaauauuaccucguugagguu

SEQ ID NO: 6226 - RNA, 23 nt, artificial
  Chemically synthesized
caauucccagaaaagcccagaga

SEQ ID NO: 6227 - RNA, 23 nt, artificial
  Chemically synthesized
aauucccagaaaagcccagagau

SEQ ID NO: 6228 - RNA, 23 nt, artificial
  Chemically synthesized
auucccagaaaagcccagagaug

SEQ ID NO: 6229 - RNA, 23 nt, artificial
  Chemically synthesized
uucccagaaaagcccagagauga

SEQ ID NO: 6230 - RNA, 23 nt, artificial
  Chemically synthesized
ugcauaacacaaccucgcaagcc

SEQ ID NO: 6231 - RNA, 23 nt, artificial
  Chemically synthesized
gcauaacacaaccucgcaagccg

SEQ ID NO: 6232 - RNA, 23 nt, artificial
  Chemically synthesized
cauaacacaaccucgcaagccgc

SEQ ID NO: 6233 - RNA, 23 nt, artificial
  Chemically synthesized
auaacacaaccucgcaagccgca

SEQ ID NO: 6234 - RNA, 23 nt, artificial
  Chemically synthesized
uaacacaaccucgcaagccgcag

SEQ ID NO: 6235 - RNA, 23 nt, artificial
  Chemically synthesized
gaagcaguuccauuauugccgua

SEQ ID NO: 6236 - RNA, 23 nt, artificial
  Chemically synthesized
aagcaguuccauuauugccguaa

SEQ ID NO: 6237 - RNA, 23 nt, artificial
  Chemically synthesized
agcaguuccauuauugccguaau

SEQ ID NO: 6238 - RNA, 23 nt, artificial
  Chemically synthesized
guuguuccaaucagugaguaaag

SEQ ID NO: 6239 - RNA, 23 nt, artificial
  Chemically synthesized
uuguuccaaucagugaguaaagu

SEQ ID NO: 6240 - RNA, 23 nt, artificial
  Chemically synthesized
uguuccaaucagugaguaaaguu

SEQ ID NO: 6241 - RNA, 23 nt, artificial
  Chemically synthesized
guuccaaucagugaguaaaguuu

SEQ ID NO: 6242 - RNA, 23 nt, artificial
  Chemically synthesized
uuccaaucagugaguaaaguuuu

SEQ ID NO: 6243 - RNA, 23 nt, artificial
  Chemically synthesized
uaauccuaccuuccugucuaaaa

SEQ ID NO: 6244 - RNA, 23 nt, artificial
  Chemically synthesized
aaaacauuagagugaggaaguca

SEQ ID NO: 6245 - RNA, 23 nt, artificial
  Chemically synthesized
gaccucuacuaaagaaaaagucc

SEQ ID NO: 6246 - RNA, 23 nt, artificial
  Chemically synthesized
accucuacuaaagaaaaaguccc

SEQ ID NO: 6247 - RNA, 23 nt, artificial
  Chemically synthesized
ccucuacuaaagaaaaagucccu

SEQ ID NO: 6248 - RNA, 23 nt, artificial
  Chemically synthesized
cucuacuaaagaaaaagucccug

SEQ ID NO: 6249 - RNA, 23 nt, artificial
  Chemically synthesized
ucuacuaaagaaaaagucccuga

SEQ ID NO: 6250 - RNA, 23 nt, artificial
  Chemically synthesized
auagauuacuaagugaaucagag

SEQ ID NO: 6251 - RNA, 23 nt, artificial
  Chemically synthesized
uagauuacuaagugaaucagaga

SEQ ID NO: 6252 - RNA, 23 nt, artificial
  Chemically synthesized
aaaauaaggccuuuauuauuccc

SEQ ID NO: 6253 - RNA, 23 nt, artificial
  Chemically synthesized
aaauaaggccuuuauuauucccu

SEQ ID NO: 6254 - RNA, 23 nt, artificial
  Chemically synthesized
aauaaggccuuuauuauucccua

SEQ ID NO: 6255 - RNA, 23 nt, artificial
  Chemically synthesized
auaaggccuuuauuauucccuag

SEQ ID NO: 6256 - RNA, 23 nt, artificial
  Chemically synthesized
uaaggccuuuauuauucccuagu

SEQ ID NO: 6257 - RNA, 23 nt, artificial
  Chemically synthesized
aauuuccuauccucacagguauu

SEQ ID NO: 6258 - RNA, 23 nt, artificial
  Chemically synthesized
auuuccuauccucacagguauuc

SEQ ID NO: 6259 - RNA, 23 nt, artificial
  Chemically synthesized
uuuccuauccucacagguauuca

SEQ ID NO: 6260 - RNA, 23 nt, artificial
  Chemically synthesized
ucccuagugacagguauccaagg

SEQ ID NO: 6261 - RNA, 23 nt, artificial
  Chemically synthesized
aaagaaaaagucccugaagcuag

SEQ ID NO: 6262 - RNA, 23 nt, artificial
  Chemically synthesized
aagaaaaagucccugaagcuagu

SEQ ID NO: 6263 - RNA, 23 nt, artificial
  Chemically synthesized
agaaaaagucccugaagcuaguc

SEQ ID NO: 6264 - RNA, 23 nt, artificial
  Chemically synthesized
gaaaaagucccugaagcuagucc

SEQ ID NO: 6265 - RNA, 23 nt, artificial
  Chemically synthesized
aaaaagucccugaagcuagucca

SEQ ID NO: 6266 - RNA, 23 nt, artificial
  Chemically synthesized
aagauuggcuuuguaguaucuuu

SEQ ID NO: 6267 - RNA, 23 nt, artificial
  Chemically synthesized
ucacacacaauccuauccagcuu

SEQ ID NO: 6268 - RNA, 23 nt, artificial
  Chemically synthesized
gugguuacugaaauggcaccaca

SEQ ID NO: 6269 - RNA, 23 nt, artificial
  Chemically synthesized
ugguuacugaaauggcaccacaa

SEQ ID NO: 6270 - RNA, 23 nt, artificial
  Chemically synthesized
gguuacugaaauggcaccacaag

SEQ ID NO: 6271 - RNA, 23 nt, artificial
  Chemically synthesized
guuacugaaauggcaccacaagc

SEQ ID NO: 6272 - RNA, 23 nt, artificial
  Chemically synthesized
uuacugaaauggcaccacaagcu

SEQ ID NO: 6273 - RNA, 23 nt, artificial
  Chemically synthesized
uaucuuggcccaauucuauaaag

SEQ ID NO: 6274 - RNA, 23 nt, artificial
  Chemically synthesized
cuauuaccaagccuaccugaaac

SEQ ID NO: 6275 - RNA, 23 nt, artificial
  Chemically synthesized
uauuaccaagccuaccugaaacc

SEQ ID NO: 6276 - RNA, 23 nt, artificial
  Chemically synthesized
auuaccaagccuaccugaaacca

SEQ ID NO: 6277 - RNA, 23 nt, artificial
  Chemically synthesized
uuaccaagccuaccugaaaccaa

SEQ ID NO: 6278 - RNA, 23 nt, artificial
  Chemically synthesized
uaccaagccuaccugaaaccaaa

SEQ ID NO: 6279 - RNA, 23 nt, artificial
  Chemically synthesized
auaagcuccuuauccacgaccca

SEQ ID NO: 6280 - RNA, 23 nt, artificial
  Chemically synthesized
uaagcuccuuauccacgacccac

SEQ ID NO: 6281 - RNA, 23 nt, artificial
  Chemically synthesized
gccuuccauaagccaucaccauu

SEQ ID NO: 6282 - RNA, 23 nt, artificial
  Chemically synthesized
ccuuccauaagccaucaccauuu

SEQ ID NO: 6283 - RNA, 23 nt, artificial
  Chemically synthesized
cuuccauaagccaucaccauuuu

SEQ ID NO: 6284 - RNA, 23 nt, artificial
  Chemically synthesized
uuccauaagccaucaccauuuug

SEQ ID NO: 6285 - RNA, 23 nt, artificial
  Chemically synthesized
uacugaaauggcaccacaagcuu

SEQ ID NO: 6286 - RNA, 23 nt, artificial
  Chemically synthesized
acugaaauggcaccacaagcuuu

SEQ ID NO: 6287 - RNA, 23 nt, artificial
  Chemically synthesized
cugaaauggcaccacaagcuuuu

SEQ ID NO: 6288 - RNA, 23 nt, artificial
  Chemically synthesized
gggcuucuacuuuugcuuaccua

SEQ ID NO: 6289 - RNA, 23 nt, artificial
  Chemically synthesized
cuucuccaaaggccagaaaauca

SEQ ID NO: 6290 - RNA, 23 nt, artificial
  Chemically synthesized
uucuccaaaggccagaaaaucag

SEQ ID NO: 6291 - RNA, 23 nt, artificial
  Chemically synthesized
ucuccaaaggccagaaaaucagc

SEQ ID NO: 6292 - RNA, 23 nt, artificial
  Chemically synthesized
uccaaaggccagaaaaucagccu

SEQ ID NO: 6293 - RNA, 23 nt, artificial
  Chemically synthesized
cuacaucgaugcccaagaagccu

SEQ ID NO: 6294 - RNA, 23 nt, artificial
  Chemically synthesized
uacaucgaugcccaagaagccuu

SEQ ID NO: 6295 - RNA, 23 nt, artificial
  Chemically synthesized
acaucgaugcccaagaagccuug

SEQ ID NO: 6296 - RNA, 23 nt, artificial
  Chemically synthesized
ugcaugcaugguuaucuggacgg

SEQ ID NO: 6297 - RNA, 23 nt, artificial
  Chemically synthesized
gcaugcaugguuaucuggacggu

SEQ ID NO: 6298 - RNA, 23 nt, artificial
  Chemically synthesized
caugcaugguuaucuggacggug

SEQ ID NO: 6299 - RNA, 23 nt, artificial
  Chemically synthesized
augcaugguuaucuggacgguga

SEQ ID NO: 6300 - RNA, 23 nt, artificial
  Chemically synthesized
ugcaugguuaucuggacggugag

SEQ ID NO: 6301 - RNA, 23 nt, artificial
  Chemically synthesized
aaaaucugggugcaugcaugguu

SEQ ID NO: 6302 - RNA, 23 nt, artificial
  Chemically synthesized
aaaucugggugcaugcaugguua

SEQ ID NO: 6303 - RNA, 23 nt, artificial
  Chemically synthesized
aaucugggugcaugcaugguuau

SEQ ID NO: 6304 - RNA, 23 nt, artificial
  Chemically synthesized
aucugggugcaugcaugguuauc

SEQ ID NO: 6305 - RNA, 23 nt, artificial
  Chemically synthesized
ucugggugcaugcaugguuaucu

SEQ ID NO: 6306 - RNA, 23 nt, artificial
  Chemically synthesized
auugauuuaucuuggcccaauuc

SEQ ID NO: 6307 - RNA, 23 nt, artificial
  Chemically synthesized
cagaacuaauuuccuauccucac

SEQ ID NO: 6308 - RNA, 23 nt, artificial
  Chemically synthesized
agaacuaauuuccuauccucaca

SEQ ID NO: 6309 - RNA, 23 nt, artificial
  Chemically synthesized
agguauccaagguggaaaaaauc

SEQ ID NO: 6310 - RNA, 23 nt, artificial
  Chemically synthesized
aauguaaaacucaaaugggcuuc

SEQ ID NO: 6311 - RNA, 23 nt, artificial
  Chemically synthesized
auguaaaacucaaaugggcuucu

SEQ ID NO: 6312 - RNA, 23 nt, artificial
  Chemically synthesized
uguaaaacucaaaugggcuucua

SEQ ID NO: 6313 - RNA, 23 nt, artificial
  Chemically synthesized
guaaaacucaaaugggcuucuac

SEQ ID NO: 6314 - RNA, 23 nt, artificial
  Chemically synthesized
uaaaacucaaaugggcuucuacu

SEQ ID NO: 6315 - RNA, 23 nt, artificial
  Chemically synthesized
aguccaugagcaguucuccugcu

SEQ ID NO: 6316 - RNA, 23 nt, artificial
  Chemically synthesized
guccaugagcaguucuccugcuu

SEQ ID NO: 6317 - RNA, 23 nt, artificial
  Chemically synthesized
uccaugagcaguucuccugcuua

SEQ ID NO: 6318 - RNA, 23 nt, artificial
  Chemically synthesized
guggaaaaaaucugggugcaugc

SEQ ID NO: 6319 - RNA, 23 nt, artificial
  Chemically synthesized
uggaaaaaaucugggugcaugca

SEQ ID NO: 6320 - RNA, 23 nt, artificial
  Chemically synthesized
ggaaaaaaucugggugcaugcau

SEQ ID NO: 6321 - RNA, 23 nt, artificial
  Chemically synthesized
gaaaaaaucugggugcaugcaug

SEQ ID NO: 6322 - RNA, 23 nt, artificial
  Chemically synthesized
aaaaaaucugggugcaugcaugg

SEQ ID NO: 6323 - RNA, 23 nt, artificial
  Chemically synthesized
aguagucaaaaucacuuagcagg

SEQ ID NO: 6324 - RNA, 23 nt, artificial
  Chemically synthesized
ucaggaacaacauaaucccagua

SEQ ID NO: 6325 - RNA, 23 nt, artificial
  Chemically synthesized
uuuguaagcauaacaggcaagag

SEQ ID NO: 6326 - RNA, 23 nt, artificial
  Chemically synthesized
cuagugacagguauccaaggugg

SEQ ID NO: 6327 - RNA, 23 nt, artificial
  Chemically synthesized
uagugacagguauccaaggugga

SEQ ID NO: 6328 - RNA, 23 nt, artificial
  Chemically synthesized
agugacagguauccaagguggaa

SEQ ID NO: 6329 - RNA, 23 nt, artificial
  Chemically synthesized
gugacagguauccaagguggaaa

SEQ ID NO: 6330 - RNA, 23 nt, artificial
  Chemically synthesized
ugacagguauccaagguggaaaa

SEQ ID NO: 6331 - RNA, 23 nt, artificial
  Chemically synthesized
aucacuucuccaaaggccagaaa

SEQ ID NO: 6332 - RNA, 23 nt, artificial
  Chemically synthesized
acaaaaaugggaucuaugcagaa

SEQ ID NO: 6333 - RNA, 23 nt, artificial
  Chemically synthesized
caaaaaugggaucuaugcagaaa

SEQ ID NO: 6334 - RNA, 23 nt, artificial
  Chemically synthesized
aaaaaugggaucuaugcagaaaa

SEQ ID NO: 6335 - RNA, 23 nt, artificial
  Chemically synthesized
auuaccucguugagguuggguuc

SEQ ID NO: 6336 - RNA, 23 nt, artificial
  Chemically synthesized
agcaauucucugggucaguuucu

SEQ ID NO: 6337 - RNA, 23 nt, artificial
  Chemically synthesized
uagagugaggaagucaccaagaa

SEQ ID NO: 6338 - RNA, 23 nt, artificial
  Chemically synthesized
aaggccuuuauuauucccuagug

SEQ ID NO: 6339 - RNA, 23 nt, artificial
  Chemically synthesized
caccauuuuguaagcauaacagg

SEQ ID NO: 6340 - RNA, 23 nt, artificial
  Chemically synthesized
aaacucaaaugggcuucuacuuu

SEQ ID NO: 6341 - RNA, 23 nt, artificial
  Chemically synthesized
aacucaaaugggcuucuacuuuu

SEQ ID NO: 6342 - RNA, 23 nt, artificial
  Chemically synthesized
acucaaaugggcuucuacuuuug

SEQ ID NO: 6343 - RNA, 23 nt, artificial
  Chemically synthesized
cucaaaugggcuucuacuuuugc

SEQ ID NO: 6344 - RNA, 23 nt, artificial
  Chemically synthesized
ucaaaugggcuucuacuuuugcu

SEQ ID NO: 6345 - RNA, 23 nt, artificial
  Chemically synthesized
acauaaucccaguagucaaaauc

SEQ ID NO: 6346 - RNA, 23 nt, artificial
  Chemically synthesized
cauaaucccaguagucaaaauca

SEQ ID NO: 6347 - RNA, 23 nt, artificial
  Chemically synthesized
auaaucccaguagucaaaaucac

SEQ ID NO: 6348 - RNA, 23 nt, artificial
  Chemically synthesized
uaaucccaguagucaaaaucacu

SEQ ID NO: 6349 - RNA, 23 nt, artificial
  Chemically synthesized
aaucccaguagucaaaaucacuu

SEQ ID NO: 6350 - RNA, 23 nt, artificial
  Chemically synthesized
uaacagccuuccauaagccauca

SEQ ID NO: 6351 - RNA, 23 nt, artificial
  Chemically synthesized
cuguuaguggaaaaaggacaaca

SEQ ID NO: 6352 - RNA, 23 nt, artificial
  Chemically synthesized
uguuaguggaaaaaggacaacag

SEQ ID NO: 6353 - RNA, 23 nt, artificial
  Chemically synthesized
guuaguggaaaaaggacaacagu

SEQ ID NO: 6354 - RNA, 23 nt, artificial
  Chemically synthesized
uuaguggaaaaaggacaacaguu

SEQ ID NO: 6355 - RNA, 23 nt, artificial
  Chemically synthesized
uaguggaaaaaggacaacaguuc

SEQ ID NO: 6356 - RNA, 23 nt, artificial
  Chemically synthesized
auacaucugucccuacgccgguc

SEQ ID NO: 6357 - RNA, 23 nt, artificial
  Chemically synthesized
gaucuaugcagaaaaucuacacu

SEQ ID NO: 6358 - RNA, 23 nt, artificial
  Chemically synthesized
aucuaugcagaaaaucuacacua

SEQ ID NO: 6359 - RNA, 23 nt, artificial
  Chemically synthesized
ucuaugcagaaaaucuacacuau

SEQ ID NO: 6360 - RNA, 23 nt, artificial
  Chemically synthesized
cuaugcagaaaaucuacacuauu

SEQ ID NO: 6361 - RNA, 23 nt, artificial
  Chemically synthesized
uaugcagaaaaucuacacuauuu

SEQ ID NO: 6362 - RNA, 23 nt, artificial
  Chemically synthesized
cccuagugacagguauccaaggu

SEQ ID NO: 6363 - RNA, 23 nt, artificial
  Chemically synthesized
ccuagugacagguauccaaggug

SEQ ID NO: 6364 - RNA, 23 nt, artificial
  Chemically synthesized
ccaagguggaaaaaaucugggug

SEQ ID NO: 6365 - RNA, 23 nt, artificial
  Chemically synthesized
caagguggaaaaaaucugggugc

SEQ ID NO: 6366 - RNA, 23 nt, artificial
  Chemically synthesized
gaucucagaacuaauuuccuauc

SEQ ID NO: 6367 - RNA, 23 nt, artificial
  Chemically synthesized
aucucagaacuaauuuccuaucc

SEQ ID NO: 6368 - RNA, 23 nt, artificial
  Chemically synthesized
ucucagaacuaauuuccuauccu

SEQ ID NO: 6369 - RNA, 23 nt, artificial
  Chemically synthesized
cucagaacuaauuuccuauccuc

SEQ ID NO: 6370 - RNA, 23 nt, artificial
  Chemically synthesized
ucagaacuaauuuccuauccuca

SEQ ID NO: 6371 - RNA, 23 nt, artificial
  Chemically synthesized
gggguuucuuauuuagggcaggu

SEQ ID NO: 6372 - RNA, 23 nt, artificial
  Chemically synthesized
caaacuacaaaugacuuuagcug

SEQ ID NO: 6373 - RNA, 23 nt, artificial
  Chemically synthesized
aaacuacaaaugacuuuagcuga

SEQ ID NO: 6374 - RNA, 23 nt, artificial
  Chemically synthesized
aacuacaaaugacuuuagcugac

SEQ ID NO: 6375 - RNA, 23 nt, artificial
  Chemically synthesized
acuacaaaugacuuuagcugacu

SEQ ID NO: 6376 - RNA, 23 nt, artificial
  Chemically synthesized
cuacaaaugacuuuagcugacua

SEQ ID NO: 6377 - RNA, 23 nt, artificial
  Chemically synthesized
gaaaacuuagagaaaaaaaagcc

SEQ ID NO: 6378 - RNA, 23 nt, artificial
  Chemically synthesized
aaaacuuagagaaaaaaaagcca

SEQ ID NO: 6379 - RNA, 23 nt, artificial
  Chemically synthesized
aaacuuagagaaaaaaaagccau

SEQ ID NO: 6380 - RNA, 23 nt, artificial
  Chemically synthesized
aacuuagagaaaaaaaagccaua

SEQ ID NO: 6381 - RNA, 23 nt, artificial
  Chemically synthesized
acuuagagaaaaaaaagccauau

SEQ ID NO: 6382 - RNA, 23 nt, artificial
  Chemically synthesized
caauuuccaaguucacgugcaua

SEQ ID NO: 6383 - RNA, 23 nt, artificial
  Chemically synthesized
aauuuccaaguucacgugcauaa

SEQ ID NO: 6384 - RNA, 23 nt, artificial
  Chemically synthesized
auuuccaaguucacgugcauaac

SEQ ID NO: 6385 - RNA, 23 nt, artificial
  Chemically synthesized
uuuccaaguucacgugcauaaca

SEQ ID NO: 6386 - RNA, 23 nt, artificial
  Chemically synthesized
uuccaaguucacgugcauaacac

SEQ ID NO: 6387 - RNA, 23 nt, artificial
  Chemically synthesized
aaaagucccugaagcuaguccau

SEQ ID NO: 6388 - RNA, 23 nt, artificial
  Chemically synthesized
gccaguugcaaccauggucaacg

SEQ ID NO: 6389 - RNA, 23 nt, artificial
  Chemically synthesized
ccaguugcaaccauggucaacgg

SEQ ID NO: 6390 - RNA, 23 nt, artificial
  Chemically synthesized
caguugcaaccauggucaacggc

SEQ ID NO: 6391 - RNA, 23 nt, artificial
  Chemically synthesized
aguugcaaccauggucaacggcu

SEQ ID NO: 6392 - RNA, 23 nt, artificial
  Chemically synthesized
guugcaaccauggucaacggcuc

SEQ ID NO: 6393 - RNA, 23 nt, artificial
  Chemically synthesized
uggagcuuaacaauagacaugca

SEQ ID NO: 6394 - RNA, 23 nt, artificial
  Chemically synthesized
gccaaugcagacuucguaaauug

SEQ ID NO: 6395 - RNA, 23 nt, artificial
  Chemically synthesized
ccaaugcagacuucguaaauuga

SEQ ID NO: 6396 - RNA, 23 nt, artificial
  Chemically synthesized
caaugcagacuucguaaauugac

SEQ ID NO: 6397 - RNA, 23 nt, artificial
  Chemically synthesized
aaugcagacuucguaaauugacc

SEQ ID NO: 6398 - RNA, 23 nt, artificial
  Chemically synthesized
augcagacuucguaaauugaccc

SEQ ID NO: 6399 - RNA, 23 nt, artificial
  Chemically synthesized
uacaaaugacuuuagcugacuag

SEQ ID NO: 6400 - RNA, 23 nt, artificial
  Chemically synthesized
cacacacaauccuauccagcuuu

SEQ ID NO: 6401 - RNA, 23 nt, artificial
  Chemically synthesized
acacacaauccuauccagcuuuu

SEQ ID NO: 6402 - RNA, 23 nt, artificial
  Chemically synthesized
gaguuucauucucuaggcuguac

SEQ ID NO: 6403 - RNA, 23 nt, artificial
  Chemically synthesized
aaaguagguacgacgcuagaauc

SEQ ID NO: 6404 - RNA, 23 nt, artificial
  Chemically synthesized
aaguagguacgacgcuagaauca

SEQ ID NO: 6405 - RNA, 23 nt, artificial
  Chemically synthesized
aguagguacgacgcuagaaucac

SEQ ID NO: 6406 - RNA, 23 nt, artificial
  Chemically synthesized
guagguacgacgcuagaaucaca

SEQ ID NO: 6407 - RNA, 23 nt, artificial
  Chemically synthesized
gugaaucagagagggacuagauc

SEQ ID NO: 6408 - RNA, 23 nt, artificial
  Chemically synthesized
auuugaagaguuuaguuuguuag

SEQ ID NO: 6409 - RNA, 23 nt, artificial
  Chemically synthesized
uuugaagaguuuaguuuguuaga

SEQ ID NO: 6410 - RNA, 23 nt, artificial
  Chemically synthesized
uugaagaguuuaguuuguuagaa

SEQ ID NO: 6411 - RNA, 23 nt, artificial
  Chemically synthesized
uaaaaacccuucaaauuugaguc

SEQ ID NO: 6412 - RNA, 23 nt, artificial
  Chemically synthesized
aaaaacccuucaaauuugaguca

SEQ ID NO: 6413 - RNA, 23 nt, artificial
  Chemically synthesized
aaaacccuucaaauuugagucag

SEQ ID NO: 6414 - RNA, 23 nt, artificial
  Chemically synthesized
aaacccuucaaauuugagucagg

SEQ ID NO: 6415 - RNA, 23 nt, artificial
  Chemically synthesized
aacccuucaaauuugagucagga

SEQ ID NO: 6416 - RNA, 23 nt, artificial
  Chemically synthesized
ugaauugaacauuguugagugga

SEQ ID NO: 6417 - RNA, 23 nt, artificial
  Chemically synthesized
gaauugaacauuguugaguggag

SEQ ID NO: 6418 - RNA, 23 nt, artificial
  Chemically synthesized
aauugaacauuguugaguggagg

SEQ ID NO: 6419 - RNA, 23 nt, artificial
  Chemically synthesized
auugaacauuguugaguggaggc

SEQ ID NO: 6420 - RNA, 23 nt, artificial
  Chemically synthesized
uugaacauuguugaguggaggcu

SEQ ID NO: 6421 - RNA, 23 nt, artificial
  Chemically synthesized
gggaucuaugcagaaaaucuaca

SEQ ID NO: 6422 - RNA, 23 nt, artificial
  Chemically synthesized
ggaucuaugcagaaaaucuacac

SEQ ID NO: 6423 - RNA, 23 nt, artificial
  Chemically synthesized
acuauaaaccauaucuccauagc

SEQ ID NO: 6424 - RNA, 23 nt, artificial
  Chemically synthesized
cuauaaaccauaucuccauagcc

SEQ ID NO: 6425 - RNA, 23 nt, artificial
  Chemically synthesized
uauaaaccauaucuccauagcca

SEQ ID NO: 6426 - RNA, 23 nt, artificial
  Chemically synthesized
auaaaccauaucuccauagccaa

SEQ ID NO: 6427 - RNA, 23 nt, artificial
  Chemically synthesized
uaaaccauaucuccauagccaau

SEQ ID NO: 6428 - RNA, 23 nt, artificial
  Chemically synthesized
aauaauucaaagugguaguauac

SEQ ID NO: 6429 - RNA, 23 nt, artificial
  Chemically synthesized
auaauucaaagugguaguauaca

SEQ ID NO: 6430 - RNA, 23 nt, artificial
  Chemically synthesized
uaauucaaagugguaguauacag

SEQ ID NO: 6431 - RNA, 23 nt, artificial
  Chemically synthesized
aauucaaagugguaguauacagc

SEQ ID NO: 6432 - RNA, 23 nt, artificial
  Chemically synthesized
auucaaagugguaguauacagcu

SEQ ID NO: 6433 - RNA, 23 nt, artificial
  Chemically synthesized
uugcaaccauggucaacggcucu

SEQ ID NO: 6434 - RNA, 23 nt, artificial
  Chemically synthesized
aaauugacccguuucaauaauuc

SEQ ID NO: 6435 - RNA, 23 nt, artificial
  Chemically synthesized
aauugacccguuucaauaauuca

SEQ ID NO: 6436 - RNA, 23 nt, artificial
  Chemically synthesized
auugacccguuucaauaauucaa

SEQ ID NO: 6437 - RNA, 23 nt, artificial
  Chemically synthesized
uugacccguuucaauaauucaaa

SEQ ID NO: 6438 - RNA, 23 nt, artificial
  Chemically synthesized
ugacccguuucaauaauucaaag

SEQ ID NO: 6439 - RNA, 23 nt, artificial
  Chemically synthesized
caaauguaaaacucaaaugggcu

SEQ ID NO: 6440 - RNA, 23 nt, artificial
  Chemically synthesized
aaauguaaaacucaaaugggcuu

SEQ ID NO: 6441 - RNA, 23 nt, artificial
  Chemically synthesized
acgcuagaaucacacacaauccu

SEQ ID NO: 6442 - RNA, 23 nt, artificial
  Chemically synthesized
cgcuagaaucacacacaauccua

SEQ ID NO: 6443 - RNA, 23 nt, artificial
  Chemically synthesized
gcuagaaucacacacaauccuau

SEQ ID NO: 6444 - RNA, 23 nt, artificial
  Chemically synthesized
cuagaaucacacacaauccuauc

SEQ ID NO: 6445 - RNA, 23 nt, artificial
  Chemically synthesized
uguaguaucuuuccaagcauuug

SEQ ID NO: 6446 - RNA, 23 nt, artificial
  Chemically synthesized
aaaccauaucuccauagccaaug

SEQ ID NO: 6447 - RNA, 23 nt, artificial
  Chemically synthesized
aagauaacuguuaguggaaaaag

SEQ ID NO: 6448 - RNA, 23 nt, artificial
  Chemically synthesized
agauaacuguuaguggaaaaagg

SEQ ID NO: 6449 - RNA, 23 nt, artificial
  Chemically synthesized
gauaacuguuaguggaaaaagga

SEQ ID NO: 6450 - RNA, 23 nt, artificial
  Chemically synthesized
auaacuguuaguggaaaaaggac

SEQ ID NO: 6451 - RNA, 23 nt, artificial
  Chemically synthesized
uaacuguuaguggaaaaaggaca

SEQ ID NO: 6452 - RNA, 23 nt, artificial
  Chemically synthesized
aagguggaaaaaaucugggugca

SEQ ID NO: 6453 - RNA, 23 nt, artificial
  Chemically synthesized
auauauuuucccuuuuuaggacc

SEQ ID NO: 6454 - RNA, 23 nt, artificial
  Chemically synthesized
acuaaagaaaaagucccugaagc

SEQ ID NO: 6455 - RNA, 23 nt, artificial
  Chemically synthesized
cuaaagaaaaagucccugaagcu

SEQ ID NO: 6456 - RNA, 23 nt, artificial
  Chemically synthesized
uaaagaaaaagucccugaagcua

SEQ ID NO: 6457 - RNA, 23 nt, artificial
  Chemically synthesized
uuguugccucuuuaaaacauuag

SEQ ID NO: 6458 - RNA, 23 nt, artificial
  Chemically synthesized
aaaaauaaggccuuuauuauucc

SEQ ID NO: 6459 - RNA, 23 nt, artificial
  Chemically synthesized
ggagcuuaacaauagacaugcaa

SEQ ID NO: 6460 - RNA, 23 nt, artificial
  Chemically synthesized
gagcuuaacaauagacaugcaaa

SEQ ID NO: 6461 - RNA, 23 nt, artificial
  Chemically synthesized
agcuuaacaauagacaugcaaaa

SEQ ID NO: 6462 - RNA, 23 nt, artificial
  Chemically synthesized
uucaaagugguaguauacagcua

SEQ ID NO: 6463 - RNA, 23 nt, artificial
  Chemically synthesized
ucaaagugguaguauacagcuac

SEQ ID NO: 6464 - RNA, 23 nt, artificial
  Chemically synthesized
ugggaucuaugcagaaaaucuac

SEQ ID NO: 6465 - RNA, 23 nt, artificial
  Chemically synthesized
uccaaguucacgugcauaacaca

SEQ ID NO: 6466 - RNA, 23 nt, artificial
  Chemically synthesized
gagcaauucucugggucaguuuc

SEQ ID NO: 6467 - RNA, 23 nt, artificial
  Chemically synthesized
ugguuaucuggacggugaguuuc

SEQ ID NO: 6468 - RNA, 23 nt, artificial
  Chemically synthesized
gguuaucuggacggugaguuuca

SEQ ID NO: 6469 - RNA, 23 nt, artificial
  Chemically synthesized
guuaucuggacggugaguuucau

SEQ ID NO: 6470 - RNA, 23 nt, artificial
  Chemically synthesized
uuaucuggacggugaguuucauu

SEQ ID NO: 6471 - RNA, 23 nt, artificial
  Chemically synthesized
accauggucaacggcucuguuuc

SEQ ID NO: 6472 - RNA, 23 nt, artificial
  Chemically synthesized
ccauggucaacggcucuguuucc

SEQ ID NO: 6473 - RNA, 23 nt, artificial
  Chemically synthesized
cauggucaacggcucuguuuccu

SEQ ID NO: 6474 - RNA, 23 nt, artificial
  Chemically synthesized
auggucaacggcucuguuuccuu

SEQ ID NO: 6475 - RNA, 23 nt, artificial
  Chemically synthesized
uggucaacggcucuguuuccuuc

SEQ ID NO: 6476 - RNA, 23 nt, artificial
  Chemically synthesized
ugaguuucauucucuaggcugua

SEQ ID NO: 6477 - RNA, 23 nt, artificial
  Chemically synthesized
ugagcugaggaucagaguucucc

SEQ ID NO: 6478 - RNA, 23 nt, artificial
  Chemically synthesized
gagcugaggaucagaguucuccu

SEQ ID NO: 6479 - RNA, 23 nt, artificial
  Chemically synthesized
agcugaggaucagaguucuccug

SEQ ID NO: 6480 - RNA, 23 nt, artificial
  Chemically synthesized
gcugaggaucagaguucuccuga

SEQ ID NO: 6481 - RNA, 23 nt, artificial
  Chemically synthesized
cugaggaucagaguucuccugaa

SEQ ID NO: 6482 - RNA, 23 nt, artificial
  Chemically synthesized
cuacuaaagaaaaagucccugaa

SEQ ID NO: 6483 - RNA, 23 nt, artificial
  Chemically synthesized
uacuaaagaaaaagucccugaag

SEQ ID NO: 6484 - RNA, 23 nt, artificial
  Chemically synthesized
acucaauggaagaguaaucaacu

SEQ ID NO: 6485 - RNA, 23 nt, artificial
  Chemically synthesized
cucaauggaagaguaaucaacua

SEQ ID NO: 6486 - RNA, 23 nt, artificial
  Chemically synthesized
ucaauggaagaguaaucaacuac

SEQ ID NO: 6487 - RNA, 23 nt, artificial
  Chemically synthesized
caauggaagaguaaucaacuaca

SEQ ID NO: 6488 - RNA, 23 nt, artificial
  Chemically synthesized
aauggaagaguaaucaacuacac

SEQ ID NO: 6489 - RNA, 23 nt, artificial
  Chemically synthesized
gacccuucaaucacuguuguucc

SEQ ID NO: 6490 - RNA, 23 nt, artificial
  Chemically synthesized
acccuucaaucacuguuguucca

SEQ ID NO: 6491 - RNA, 23 nt, artificial
  Chemically synthesized
cccuucaaucacuguuguuccaa

SEQ ID NO: 6492 - RNA, 23 nt, artificial
  Chemically synthesized
ccuucaaucacuguuguuccaau

SEQ ID NO: 6493 - RNA, 23 nt, artificial
  Chemically synthesized
cuucaaucacuguuguuccaauc

SEQ ID NO: 6494 - RNA, 23 nt, artificial
  Chemically synthesized
caauucuauaaagauuggcuuug

SEQ ID NO: 6495 - RNA, 23 nt, artificial
  Chemically synthesized
aauucuauaaagauuggcuuugu

SEQ ID NO: 6496 - RNA, 23 nt, artificial
  Chemically synthesized
auucuauaaagauuggcuuugua

SEQ ID NO: 6497 - RNA, 23 nt, artificial
  Chemically synthesized
uucuauaaagauuggcuuuguag

SEQ ID NO: 6498 - RNA, 23 nt, artificial
  Chemically synthesized
ucuauaaagauuggcuuuguagu

SEQ ID NO: 6499 - RNA, 23 nt, artificial
  Chemically synthesized
agacuucguaaauugacccguuu

SEQ ID NO: 6500 - RNA, 23 nt, artificial
  Chemically synthesized
caucgaugcccaagaagccuugc

SEQ ID NO: 6501 - RNA, 23 nt, artificial
  Chemically synthesized
aucgaugcccaagaagccuugcc

SEQ ID NO: 6502 - RNA, 23 nt, artificial
  Chemically synthesized
ucgaugcccaagaagccuugccc

SEQ ID NO: 6503 - RNA, 23 nt, artificial
  Chemically synthesized
ucucugggucaguuucucaggga

SEQ ID NO: 6504 - RNA, 23 nt, artificial
  Chemically synthesized
cucugggucaguuucucagggac

SEQ ID NO: 6505 - RNA, 23 nt, artificial
  Chemically synthesized
ucugggucaguuucucagggaca

SEQ ID NO: 6506 - RNA, 23 nt, artificial
  Chemically synthesized
ccauaucuccauagccaaugcag

SEQ ID NO: 6507 - RNA, 23 nt, artificial
  Chemically synthesized
cauaucuccauagccaaugcaga

SEQ ID NO: 6508 - RNA, 23 nt, artificial
  Chemically synthesized
auaucuccauagccaaugcagac

SEQ ID NO: 6509 - RNA, 23 nt, artificial
  Chemically synthesized
uaucuccauagccaaugcagacu

SEQ ID NO: 6510 - RNA, 23 nt, artificial
  Chemically synthesized
aucuccauagccaaugcagacuu

SEQ ID NO: 6511 - RNA, 23 nt, artificial
  Chemically synthesized
cgacgcuagaaucacacacaauc

SEQ ID NO: 6512 - RNA, 23 nt, artificial
  Chemically synthesized
gacgcuagaaucacacacaaucc

SEQ ID NO: 6513 - RNA, 23 nt, artificial
  Chemically synthesized
acaaaugacuuuagcugacuagc

SEQ ID NO: 6514 - RNA, 23 nt, artificial
  Chemically synthesized
caaaugacuuuagcugacuagcu

SEQ ID NO: 6515 - RNA, 23 nt, artificial
  Chemically synthesized
aaaugacuuuagcugacuagcug

SEQ ID NO: 6516 - RNA, 23 nt, artificial
  Chemically synthesized
aaugacuuuagcugacuagcuga

SEQ ID NO: 6517 - RNA, 23 nt, artificial
  Chemically synthesized
augacuuuagcugacuagcugaa

SEQ ID NO: 6518 - RNA, 23 nt, artificial
  Chemically synthesized
ucaguaacaccaggaugaauaca

SEQ ID NO: 6519 - RNA, 23 nt, artificial
  Chemically synthesized
caguaacaccaggaugaauacau

SEQ ID NO: 6520 - RNA, 23 nt, artificial
  Chemically synthesized
aguaacaccaggaugaauacauc

SEQ ID NO: 6521 - RNA, 23 nt, artificial
  Chemically synthesized
cuagcugaauaguuuuacuaccc

SEQ ID NO: 6522 - RNA, 23 nt, artificial
  Chemically synthesized
uagcugaauaguuuuacuaccca

SEQ ID NO: 6523 - RNA, 23 nt, artificial
  Chemically synthesized
agcugaauaguuuuacuacccaa

SEQ ID NO: 6524 - RNA, 23 nt, artificial
  Chemically synthesized
gcugaauaguuuuacuacccaau

SEQ ID NO: 6525 - RNA, 23 nt, artificial
  Chemically synthesized
uucaaucacuguuguuccaauca

SEQ ID NO: 6526 - RNA, 23 nt, artificial
  Chemically synthesized
ucaaucacuguuguuccaaucag

SEQ ID NO: 6527 - RNA, 23 nt, artificial
  Chemically synthesized
caaucacuguuguuccaaucagu

SEQ ID NO: 6528 - RNA, 23 nt, artificial
  Chemically synthesized
aaucacuguuguuccaaucagug

SEQ ID NO: 6529 - RNA, 23 nt, artificial
  Chemically synthesized
ggcaagagagucaaagauaacug

SEQ ID NO: 6530 - RNA, 23 nt, artificial
  Chemically synthesized
gcaagagagucaaagauaacugu

SEQ ID NO: 6531 - RNA, 23 nt, artificial
  Chemically synthesized
caagagagucaaagauaacuguu

SEQ ID NO: 6532 - RNA, 23 nt, artificial
  Chemically synthesized
aagagagucaaagauaacuguua

SEQ ID NO: 6533 - RNA, 23 nt, artificial
  Chemically synthesized
agagagucaaagauaacuguuag

SEQ ID NO: 6534 - RNA, 23 nt, artificial
  Chemically synthesized
agccuaccugaaaccaaauugug

SEQ ID NO: 6535 - RNA, 23 nt, artificial
  Chemically synthesized
gccuaccugaaaccaaauugugg

SEQ ID NO: 6536 - RNA, 23 nt, artificial
  Chemically synthesized
ccuaccugaaaccaaauugugga

SEQ ID NO: 6537 - RNA, 23 nt, artificial
  Chemically synthesized
cuaccugaaaccaaauuguggaa

SEQ ID NO: 6538 - RNA, 23 nt, artificial
  Chemically synthesized
uaccugaaaccaaauuguggaau

SEQ ID NO: 6539 - RNA, 23 nt, artificial
  Chemically synthesized
uacacuauuuugaaucacuucuc

SEQ ID NO: 6540 - RNA, 23 nt, artificial
  Chemically synthesized
gauacuucaauucccagaaaagc

SEQ ID NO: 6541 - RNA, 23 nt, artificial
  Chemically synthesized
ucuccauagccaaugcagacuuc

SEQ ID NO: 6542 - RNA, 23 nt, artificial
  Chemically synthesized
cuauaaagauuggcuuuguagua

SEQ ID NO: 6543 - RNA, 23 nt, artificial
  Chemically synthesized
uauaaagauuggcuuuguaguau

SEQ ID NO: 6544 - RNA, 23 nt, artificial
  Chemically synthesized
auaaagauuggcuuuguaguauc

SEQ ID NO: 6545 - RNA, 23 nt, artificial
  Chemically synthesized
uaaagauuggcuuuguaguaucu

SEQ ID NO: 6546 - RNA, 23 nt, artificial
  Chemically synthesized
augcagaaaaucuacacuauuuu

SEQ ID NO: 6547 - RNA, 23 nt, artificial
  Chemically synthesized
caaaugggcuucuacuuuugcuu

SEQ ID NO: 6548 - RNA, 23 nt, artificial
  Chemically synthesized
aaaugggcuucuacuuuugcuua

SEQ ID NO: 6549 - RNA, 23 nt, artificial
  Chemically synthesized
aaugggcuucuacuuuugcuuac

SEQ ID NO: 6550 - RNA, 23 nt, artificial
  Chemically synthesized
ugcagacuucguaaauugacccg

SEQ ID NO: 6551 - RNA, 23 nt, artificial
  Chemically synthesized
gcagacuucguaaauugacccgu

SEQ ID NO: 6552 - RNA, 23 nt, artificial
  Chemically synthesized
cagacuucguaaauugacccguu

SEQ ID NO: 6553 - RNA, 23 nt, artificial
  Chemically synthesized
aucacuguuguuccaaucaguga

SEQ ID NO: 6554 - RNA, 23 nt, artificial
  Chemically synthesized
ggauaugaaagccuugcugaauu

SEQ ID NO: 6555 - RNA, 23 nt, artificial
  Chemically synthesized
gauaugaaagccuugcugaauug

SEQ ID NO: 6556 - RNA, 23 nt, artificial
  Chemically synthesized
auaugaaagccuugcugaauuga

SEQ ID NO: 6557 - RNA, 23 nt, artificial
  Chemically synthesized
uaugaaagccuugcugaauugaa

SEQ ID NO: 6558 - RNA, 23 nt, artificial
  Chemically synthesized
augaaagccuugcugaauugaac

SEQ ID NO: 6559 - RNA, 23 nt, artificial
  Chemically synthesized
uuccuauccucacagguauucau

SEQ ID NO: 6560 - RNA, 23 nt, artificial
  Chemically synthesized
uuuacuacccaaucaugaaauaa

SEQ ID NO: 6561 - RNA, 23 nt, artificial
  Chemically synthesized
caaaaucacuuagcaggcucucu

SEQ ID NO: 6562 - RNA, 23 nt, artificial
  Chemically synthesized
cauuuacucuuaccuaggguuaa

SEQ ID NO: 6563 - RNA, 23 nt, artificial
  Chemically synthesized
auuuacucuuaccuaggguuaag

SEQ ID NO: 6564 - RNA, 23 nt, artificial
  Chemically synthesized
uuuacucuuaccuaggguuaagc

SEQ ID NO: 6565 - RNA, 23 nt, artificial
  Chemically synthesized
uuacucuuaccuaggguuaagcu

SEQ ID NO: 6566 - RNA, 23 nt, artificial
  Chemically synthesized
aguggaaaaaggacaacaguucu

SEQ ID NO: 6567 - RNA, 23 nt, artificial
  Chemically synthesized
guggaaaaaggacaacaguucua

SEQ ID NO: 6568 - RNA, 23 nt, artificial
  Chemically synthesized
uggaaaaaggacaacaguucuac

SEQ ID NO: 6569 - RNA, 23 nt, artificial
  Chemically synthesized
acaguccagcaauucugaaaugc

SEQ ID NO: 6570 - RNA, 23 nt, artificial
  Chemically synthesized
caguccagcaauucugaaaugcu

SEQ ID NO: 6571 - RNA, 23 nt, artificial
  Chemically synthesized
aguccagcaauucugaaaugcug

SEQ ID NO: 6572 - RNA, 23 nt, artificial
  Chemically synthesized
guccagcaauucugaaaugcugg

SEQ ID NO: 6573 - RNA, 23 nt, artificial
  Chemically synthesized
uccagcaauucugaaaugcuggc

SEQ ID NO: 6574 - RNA, 23 nt, artificial
  Chemically synthesized
aguguaagcucaaaaguagguac

SEQ ID NO: 6575 - RNA, 23 nt, artificial
  Chemically synthesized
guguaagcucaaaaguagguacg

SEQ ID NO: 6576 - RNA, 23 nt, artificial
  Chemically synthesized
uguaagcucaaaaguagguacga

SEQ ID NO: 6577 - RNA, 23 nt, artificial
  Chemically synthesized
guaagcucaaaaguagguacgac

SEQ ID NO: 6578 - RNA, 23 nt, artificial
  Chemically synthesized
gaucuacuuaguuggaauaagac

SEQ ID NO: 6579 - RNA, 23 nt, artificial
  Chemically synthesized
aucuacuuaguuggaauaagaca

SEQ ID NO: 6580 - RNA, 23 nt, artificial
  Chemically synthesized
ucuacuuaguuggaauaagacaa

SEQ ID NO: 6581 - RNA, 23 nt, artificial
  Chemically synthesized
cuacuuaguuggaauaagacaaa

SEQ ID NO: 6582 - RNA, 23 nt, artificial
  Chemically synthesized
uacuuaguuggaauaagacaaaa

SEQ ID NO: 6583 - RNA, 23 nt, artificial
  Chemically synthesized
gcaguucuccugcuuaaacacaa

SEQ ID NO: 6584 - RNA, 23 nt, artificial
  Chemically synthesized
caguucuccugcuuaaacacaag

SEQ ID NO: 6585 - RNA, 23 nt, artificial
  Chemically synthesized
aguucuccugcuuaaacacaagu

SEQ ID NO: 6586 - RNA, 23 nt, artificial
  Chemically synthesized
guucuccugcuuaaacacaagug

SEQ ID NO: 6587 - RNA, 23 nt, artificial
  Chemically synthesized
uucuccugcuuaaacacaagugu

SEQ ID NO: 6588 - RNA, 23 nt, artificial
  Chemically synthesized
uuuuaaccaaauucuggcaaguu

SEQ ID NO: 6589 - RNA, 23 nt, artificial
  Chemically synthesized
uguugccucuuuaaaacauuaga

SEQ ID NO: 6590 - RNA, 23 nt, artificial
  Chemically synthesized
guugccucuuuaaaacauuagag

SEQ ID NO: 6591 - RNA, 23 nt, artificial
  Chemically synthesized
uugccucuuuaaaacauuagagu

SEQ ID NO: 6592 - RNA, 23 nt, artificial
  Chemically synthesized
ugccucuuuaaaacauuagagug

SEQ ID NO: 6593 - RNA, 23 nt, artificial
  Chemically synthesized
uaaaaaauccucugaaaacuuag

SEQ ID NO: 6594 - RNA, 23 nt, artificial
  Chemically synthesized
aaaaaauccucugaaaacuuaga

SEQ ID NO: 6595 - RNA, 23 nt, artificial
  Chemically synthesized
aaaaauccucugaaaacuuagag

SEQ ID NO: 6596 - RNA, 23 nt, artificial
  Chemically synthesized
aaaauccucugaaaacuuagaga

SEQ ID NO: 6597 - RNA, 23 nt, artificial
  Chemically synthesized
aaauccucugaaaacuuagagaa

SEQ ID NO: 6598 - RNA, 23 nt, artificial
  Chemically synthesized
ucucuaggcuguacuauaaacca

SEQ ID NO: 6599 - RNA, 23 nt, artificial
  Chemically synthesized
cucuaggcuguacuauaaaccau

SEQ ID NO: 6600 - RNA, 23 nt, artificial
  Chemically synthesized
ucuaggcuguacuauaaaccaua

SEQ ID NO: 6601 - RNA, 23 nt, artificial
  Chemically synthesized
cuaggcuguacuauaaaccauau

SEQ ID NO: 6602 - RNA, 23 nt, artificial
  Chemically synthesized
agaguucuccugaaaccagagga

SEQ ID NO: 6603 - RNA, 23 nt, artificial
  Chemically synthesized
gaguucuccugaaaccagaggag

SEQ ID NO: 6604 - RNA, 23 nt, artificial
  Chemically synthesized
aguucuccugaaaccagaggaga

SEQ ID NO: 6605 - RNA, 23 nt, artificial
  Chemically synthesized
guucuccugaaaccagaggagaa

SEQ ID NO: 6606 - RNA, 23 nt, artificial
  Chemically synthesized
uucuccugaaaccagaggagaag

SEQ ID NO: 6607 - RNA, 23 nt, artificial
  Chemically synthesized
uuauaaaggcaucuaaaacaaca

SEQ ID NO: 6608 - RNA, 23 nt, artificial
  Chemically synthesized
uauaaaggcaucuaaaacaacac

SEQ ID NO: 6609 - RNA, 23 nt, artificial
  Chemically synthesized
auaaaggcaucuaaaacaacacc

SEQ ID NO: 6610 - RNA, 23 nt, artificial
  Chemically synthesized
aaaggcaucuaaaacaacaccgu

SEQ ID NO: 6611 - RNA, 23 nt, artificial
  Chemically synthesized
aucccaguagucaaaaucacuua

SEQ ID NO: 6612 - RNA, 23 nt, artificial
  Chemically synthesized
acagccuuccauaagccaucacc

SEQ ID NO: 6613 - RNA, 23 nt, artificial
  Chemically synthesized
cagccuuccauaagccaucacca

SEQ ID NO: 6614 - RNA, 23 nt, artificial
  Chemically synthesized
agccuuccauaagccaucaccau

SEQ ID NO: 6615 - RNA, 23 nt, artificial
  Chemically synthesized
auacagcuacuacccuugacaau

SEQ ID NO: 6616 - RNA, 23 nt, artificial
  Chemically synthesized
uacagcuacuacccuugacaauu

SEQ ID NO: 6617 - RNA, 23 nt, artificial
  Chemically synthesized
acagcuacuacccuugacaauug

SEQ ID NO: 6618 - RNA, 23 nt, artificial
  Chemically synthesized
cuccugaaaccagaggagaagcg

SEQ ID NO: 6619 - RNA, 23 nt, artificial
  Chemically synthesized
uccugaaaccagaggagaagcga

SEQ ID NO: 6620 - RNA, 23 nt, artificial
  Chemically synthesized
ccugaaaccagaggagaagcgac

SEQ ID NO: 6621 - RNA, 23 nt, artificial
  Chemically synthesized
cugaaaccagaggagaagcgacc

SEQ ID NO: 6622 - RNA, 23 nt, artificial
  Chemically synthesized
ugaaaccagaggagaagcgaccu

SEQ ID NO: 6623 - RNA, 23 nt, artificial
  Chemically synthesized
uagacaugcaaaacaacauugau

SEQ ID NO: 6624 - RNA, 23 nt, artificial
  Chemically synthesized
caaaaguagguacgacgcuagaa

SEQ ID NO: 6625 - RNA, 23 nt, artificial
  Chemically synthesized
aaaaguagguacgacgcuagaau

SEQ ID NO: 6626 - RNA, 23 nt, artificial
  Chemically synthesized
ugggugcaugcaugguuaucugg

SEQ ID NO: 6627 - RNA, 23 nt, artificial
  Chemically synthesized
gggugcaugcaugguuaucugga

SEQ ID NO: 6628 - RNA, 23 nt, artificial
  Chemically synthesized
ggugcaugcaugguuaucuggac

SEQ ID NO: 6629 - RNA, 23 nt, artificial
  Chemically synthesized
gugcaugcaugguuaucuggacg

SEQ ID NO: 6630 - RNA, 23 nt, artificial
  Chemically synthesized
cugguggugugggcuuuuggaag

SEQ ID NO: 6631 - RNA, 23 nt, artificial
  Chemically synthesized
ugguggugugggcuuuuggaagu

SEQ ID NO: 6632 - RNA, 23 nt, artificial
  Chemically synthesized
gguggugugggcuuuuggaaguu

SEQ ID NO: 6633 - RNA, 23 nt, artificial
  Chemically synthesized
guggugugggcuuuuggaaguuu

SEQ ID NO: 6634 - RNA, 23 nt, artificial
  Chemically synthesized
uggugugggcuuuuggaaguuuu

SEQ ID NO: 6635 - RNA, 23 nt, artificial
  Chemically synthesized
aggcaagagagucaaagauaacu

SEQ ID NO: 6636 - RNA, 23 nt, artificial
  Chemically synthesized
aaagacaguauucaacacuuaag

SEQ ID NO: 6637 - RNA, 23 nt, artificial
  Chemically synthesized
aagacaguauucaacacuuaaga

SEQ ID NO: 6638 - RNA, 23 nt, artificial
  Chemically synthesized
agacaguauucaacacuuaagaa

SEQ ID NO: 6639 - RNA, 23 nt, artificial
  Chemically synthesized
gacaguauucaacacuuaagaac

SEQ ID NO: 6640 - RNA, 23 nt, artificial
  Chemically synthesized
acaguauucaacacuuaagaaca

SEQ ID NO: 6641 - RNA, 23 nt, artificial
  Chemically synthesized
gccuguuagcugcaguugcuaug

SEQ ID NO: 6642 - RNA, 23 nt, artificial
  Chemically synthesized
ccuguuagcugcaguugcuauga

SEQ ID NO: 6643 - RNA, 23 nt, artificial
  Chemically synthesized
cuguuagcugcaguugcuaugaa

SEQ ID NO: 6644 - RNA, 23 nt, artificial
  Chemically synthesized
uguuagcugcaguugcuaugaau

SEQ ID NO: 6645 - RNA, 23 nt, artificial
  Chemically synthesized
guuagcugcaguugcuaugaaug

SEQ ID NO: 6646 - RNA, 23 nt, artificial
  Chemically synthesized
auucugaaaugcuggccggguuc

SEQ ID NO: 6647 - RNA, 23 nt, artificial
  Chemically synthesized
aacaacauugauuuaucuuggcc

SEQ ID NO: 6648 - RNA, 23 nt, artificial
  Chemically synthesized
caguuccauuauugccguaauau

SEQ ID NO: 6649 - RNA, 23 nt, artificial
  Chemically synthesized
aguuccauuauugccguaauauu

SEQ ID NO: 6650 - RNA, 23 nt, artificial
  Chemically synthesized
guuccauuauugccguaauauuu

SEQ ID NO: 6651 - RNA, 23 nt, artificial
  Chemically synthesized
uuccauuauugccguaauauuuc

SEQ ID NO: 6652 - RNA, 23 nt, artificial
  Chemically synthesized
uccauuauugccguaauauuucu

SEQ ID NO: 6653 - RNA, 23 nt, artificial
  Chemically synthesized
acacaauccuauccagcuuuuua

SEQ ID NO: 6654 - RNA, 23 nt, artificial
  Chemically synthesized
gagguuggguucaggaacaacau

SEQ ID NO: 6655 - RNA, 23 nt, artificial
  Chemically synthesized
agguuggguucaggaacaacaua

SEQ ID NO: 6656 - RNA, 23 nt, artificial
  Chemically synthesized
gguuggguucaggaacaacauaa

SEQ ID NO: 6657 - RNA, 23 nt, artificial
  Chemically synthesized
guuggguucaggaacaacauaau

SEQ ID NO: 6658 - RNA, 23 nt, artificial
  Chemically synthesized
uuggguucaggaacaacauaauc

SEQ ID NO: 6659 - RNA, 23 nt, artificial
  Chemically synthesized
aggaucagaguucuccugaaacc

SEQ ID NO: 6660 - RNA, 23 nt, artificial
  Chemically synthesized
ggaucagaguucuccugaaacca

SEQ ID NO: 6661 - RNA, 23 nt, artificial
  Chemically synthesized
gaucagaguucuccugaaaccag

SEQ ID NO: 6662 - RNA, 23 nt, artificial
  Chemically synthesized
aucagaguucuccugaaaccaga

SEQ ID NO: 6663 - RNA, 23 nt, artificial
  Chemically synthesized
ucagaguucuccugaaaccagag

SEQ ID NO: 6664 - RNA, 23 nt, artificial
  Chemically synthesized
caaacugccaguugcaaccaugg

SEQ ID NO: 6665 - RNA, 23 nt, artificial
  Chemically synthesized
aaacugccaguugcaaccauggu

SEQ ID NO: 6666 - RNA, 23 nt, artificial
  Chemically synthesized
aacugccaguugcaaccaugguc

SEQ ID NO: 6667 - RNA, 23 nt, artificial
  Chemically synthesized
acugccaguugcaaccaugguca

SEQ ID NO: 6668 - RNA, 23 nt, artificial
  Chemically synthesized
auaguaucaguaacaggaucaca

SEQ ID NO: 6669 - RNA, 23 nt, artificial
  Chemically synthesized
uuacuacccaaucaugaaauaau

SEQ ID NO: 6670 - RNA, 23 nt, artificial
  Chemically synthesized
auccuaccuuccugucuaaaaac

SEQ ID NO: 6671 - RNA, 23 nt, artificial
  Chemically synthesized
uccuaccuuccugucuaaaaacc

SEQ ID NO: 6672 - RNA, 23 nt, artificial
  Chemically synthesized
ccuaccuuccugucuaaaaaccc

SEQ ID NO: 6673 - RNA, 23 nt, artificial
  Chemically synthesized
cuaccuuccugucuaaaaacccu

SEQ ID NO: 6674 - RNA, 23 nt, artificial
  Chemically synthesized
cuaauagcuagggcaggaaaccu

SEQ ID NO: 6675 - RNA, 23 nt, artificial
  Chemically synthesized
uaauagcuagggcaggaaaccug

SEQ ID NO: 6676 - RNA, 23 nt, artificial
  Chemically synthesized
aauagcuagggcaggaaaccuga

SEQ ID NO: 6677 - RNA, 23 nt, artificial
  Chemically synthesized
auagcuagggcaggaaaccugaa

SEQ ID NO: 6678 - RNA, 23 nt, artificial
  Chemically synthesized
uagcuagggcaggaaaccugaau

SEQ ID NO: 6679 - RNA, 23 nt, artificial
  Chemically synthesized
ccuugcugaauugaacauuguug

SEQ ID NO: 6680 - RNA, 23 nt, artificial
  Chemically synthesized
cuugcugaauugaacauuguuga

SEQ ID NO: 6681 - RNA, 23 nt, artificial
  Chemically synthesized
uugcugaauugaacauuguugag

SEQ ID NO: 6682 - RNA, 23 nt, artificial
  Chemically synthesized
ugcugaauugaacauuguugagu

SEQ ID NO: 6683 - RNA, 23 nt, artificial
  Chemically synthesized
gcugaauugaacauuguugagug

SEQ ID NO: 6684 - RNA, 23 nt, artificial
  Chemically synthesized
gcacauguaauacugaaaagagg

SEQ ID NO: 6685 - RNA, 23 nt, artificial
  Chemically synthesized
cacauguaauacugaaaagagga

SEQ ID NO: 6686 - RNA, 23 nt, artificial
  Chemically synthesized
acauguaauacugaaaagaggau

SEQ ID NO: 6687 - RNA, 23 nt, artificial
  Chemically synthesized
cauguaauacugaaaagaggaua

SEQ ID NO: 6688 - RNA, 23 nt, artificial
  Chemically synthesized
auguaauacugaaaagaggauag

SEQ ID NO: 6689 - RNA, 23 nt, artificial
  Chemically synthesized
guuuaaagacaguauucaacacu

SEQ ID NO: 6690 - RNA, 23 nt, artificial
  Chemically synthesized
uuuaaagacaguauucaacacuu

SEQ ID NO: 6691 - RNA, 23 nt, artificial
  Chemically synthesized
uuaaagacaguauucaacacuua

SEQ ID NO: 6692 - RNA, 23 nt, artificial
  Chemically synthesized
uaaagacaguauucaacacuuaa

SEQ ID NO: 6693 - RNA, 23 nt, artificial
  Chemically synthesized
ggacccuucaaucacuguuguuc

SEQ ID NO: 6694 - RNA, 23 nt, artificial
  Chemically synthesized
uguaauacugaaaagaggauaga

SEQ ID NO: 6695 - RNA, 23 nt, artificial
  Chemically synthesized
acuagaucucagaacuaauuucc

SEQ ID NO: 6696 - RNA, 23 nt, artificial
  Chemically synthesized
cuagaucucagaacuaauuuccu

SEQ ID NO: 6697 - RNA, 23 nt, artificial
  Chemically synthesized
uagaucucagaacuaauuuccua

SEQ ID NO: 6698 - RNA, 23 nt, artificial
  Chemically synthesized
agaucucagaacuaauuuccuau

SEQ ID NO: 6699 - RNA, 23 nt, artificial
  Chemically synthesized
aacuguuaguggaaaaaggacaa

SEQ ID NO: 6700 - RNA, 23 nt, artificial
  Chemically synthesized
ucacuucuccaaaggccagaaaa

SEQ ID NO: 6701 - RNA, 23 nt, artificial
  Chemically synthesized
cacuucuccaaaggccagaaaau

SEQ ID NO: 6702 - RNA, 23 nt, artificial
  Chemically synthesized
acuucuccaaaggccagaaaauc

SEQ ID NO: 6703 - RNA, 23 nt, artificial
  Chemically synthesized
acuaagugaaucagagagggacu

SEQ ID NO: 6704 - RNA, 23 nt, artificial
  Chemically synthesized
cuaagugaaucagagagggacua

SEQ ID NO: 6705 - RNA, 23 nt, artificial
  Chemically synthesized
uaagugaaucagagagggacuag

SEQ ID NO: 6706 - RNA, 23 nt, artificial
  Chemically synthesized
aagugaaucagagagggacuaga

SEQ ID NO: 6707 - RNA, 23 nt, artificial
  Chemically synthesized
aucuuggcccaauucuauaaaga

SEQ ID NO: 6708 - RNA, 23 nt, artificial
  Chemically synthesized
gaggaucagaguucuccugaaac

SEQ ID NO: 6709 - RNA, 23 nt, artificial
  Chemically synthesized
gugaaguggagcuaauagcuagg

SEQ ID NO: 6710 - RNA, 23 nt, artificial
  Chemically synthesized
cuaaaaacccuucaaauuugagu

SEQ ID NO: 6711 - RNA, 23 nt, artificial
  Chemically synthesized
aggccagaaaaucagccuguuag

SEQ ID NO: 6712 - RNA, 23 nt, artificial
  Chemically synthesized
ggccagaaaaucagccuguuagc

SEQ ID NO: 6713 - RNA, 23 nt, artificial
  Chemically synthesized
gccagaaaaucagccuguuagcu

SEQ ID NO: 6714 - RNA, 23 nt, artificial
  Chemically synthesized
ccagaaaaucagccuguuagcug

SEQ ID NO: 6715 - RNA, 23 nt, artificial
  Chemically synthesized
cagaaaaucagccuguuagcugc

SEQ ID NO: 6716 - RNA, 23 nt, artificial
  Chemically synthesized
aagccuugcugaauugaacauug

SEQ ID NO: 6717 - RNA, 23 nt, artificial
  Chemically synthesized
agccuugcugaauugaacauugu

SEQ ID NO: 6718 - RNA, 23 nt, artificial
  Chemically synthesized
gccuugcugaauugaacauuguu

SEQ ID NO: 6719 - RNA, 23 nt, artificial
  Chemically synthesized
acaccuguuuuucaguaacacca

SEQ ID NO: 6720 - RNA, 23 nt, artificial
  Chemically synthesized
caccuguuuuucaguaacaccag

SEQ ID NO: 6721 - RNA, 23 nt, artificial
  Chemically synthesized
accuguuuuucaguaacaccagg

SEQ ID NO: 6722 - RNA, 23 nt, artificial
  Chemically synthesized
ucguugagguuggguucaggaac

SEQ ID NO: 6723 - RNA, 23 nt, artificial
  Chemically synthesized
cguugagguuggguucaggaaca

SEQ ID NO: 6724 - RNA, 23 nt, artificial
  Chemically synthesized
guugagguuggguucaggaacaa

SEQ ID NO: 6725 - RNA, 23 nt, artificial
  Chemically synthesized
uugagguuggguucaggaacaac

SEQ ID NO: 6726 - RNA, 23 nt, artificial
  Chemically synthesized
ugagguuggguucaggaacaaca

SEQ ID NO: 6727 - RNA, 23 nt, artificial
  Chemically synthesized
ugaggaucagaguucuccugaaa

SEQ ID NO: 6728 - RNA, 23 nt, artificial
  Chemically synthesized
uuuaaccaaauucuggcaaguug

SEQ ID NO: 6729 - RNA, 23 nt, artificial
  Chemically synthesized
agaaaaucagccuguuagcugca

SEQ ID NO: 6730 - RNA, 23 nt, artificial
  Chemically synthesized
gaaaaucagccuguuagcugcag

SEQ ID NO: 6731 - RNA, 23 nt, artificial
  Chemically synthesized
aaaaucagccuguuagcugcagu

SEQ ID NO: 6732 - RNA, 23 nt, artificial
  Chemically synthesized
aaagaaaagagacuacauuuggg

SEQ ID NO: 6733 - RNA, 23 nt, artificial
  Chemically synthesized
aagaaaagagacuacauuugggg

SEQ ID NO: 6734 - RNA, 23 nt, artificial
  Chemically synthesized
agaaaagagacuacauuuggggu

SEQ ID NO: 6735 - RNA, 23 nt, artificial
  Chemically synthesized
gaaaagagacuacauuugggguu

SEQ ID NO: 6736 - RNA, 23 nt, artificial
  Chemically synthesized
aaaagagacuacauuugggguuu

SEQ ID NO: 6737 - RNA, 23 nt, artificial
  Chemically synthesized
aaaaaucugggugcaugcauggu

SEQ ID NO: 6738 - RNA, 23 nt, artificial
  Chemically synthesized
ccaagaaacagugaagcaguucc

SEQ ID NO: 6739 - RNA, 23 nt, artificial
  Chemically synthesized
caagaaacagugaagcaguucca

SEQ ID NO: 6740 - RNA, 23 nt, artificial
  Chemically synthesized
aagaaacagugaagcaguuccau

SEQ ID NO: 6741 - RNA, 23 nt, artificial
  Chemically synthesized
agaaacagugaagcaguuccauu

SEQ ID NO: 6742 - RNA, 23 nt, artificial
  Chemically synthesized
gaaacagugaagcaguuccauua

SEQ ID NO: 6743 - RNA, 23 nt, artificial
  Chemically synthesized
gcagaaacacagugaaccuuugg

SEQ ID NO: 6744 - RNA, 23 nt, artificial
  Chemically synthesized
cagaaacacagugaaccuuugga

SEQ ID NO: 6745 - RNA, 23 nt, artificial
  Chemically synthesized
agaaacacagugaaccuuuggag

SEQ ID NO: 6746 - RNA, 23 nt, artificial
  Chemically synthesized
gaaacacagugaaccuuuggagc

SEQ ID NO: 6747 - RNA, 23 nt, artificial
  Chemically synthesized
aaacacagugaaccuuuggagcu

SEQ ID NO: 6748 - RNA, 23 nt, artificial
  Chemically synthesized
acacugccauggugaaaugguuc

SEQ ID NO: 6749 - RNA, 23 nt, artificial
  Chemically synthesized
cacugccauggugaaaugguuca

SEQ ID NO: 6750 - RNA, 23 nt, artificial
  Chemically synthesized
acugccauggugaaaugguucau

SEQ ID NO: 6751 - RNA, 23 nt, artificial
  Chemically synthesized
cugccauggugaaaugguucauc

SEQ ID NO: 6752 - RNA, 23 nt, artificial
  Chemically synthesized
accuuugagcaaccaaguuuagu

SEQ ID NO: 6753 - RNA, 23 nt, artificial
  Chemically synthesized
ccuuugagcaaccaaguuuaguu

SEQ ID NO: 6754 - RNA, 23 nt, artificial
  Chemically synthesized
cuuugagcaaccaaguuuaguuu

SEQ ID NO: 6755 - RNA, 23 nt, artificial
  Chemically synthesized
uuugagcaaccaaguuuaguuug

SEQ ID NO: 6756 - RNA, 23 nt, artificial
  Chemically synthesized
uugagcaaccaaguuuaguuugc

SEQ ID NO: 6757 - RNA, 23 nt, artificial
  Chemically synthesized
aaaaugggaucuaugcagaaaau

SEQ ID NO: 6758 - RNA, 23 nt, artificial
  Chemically synthesized
aaaugggaucuaugcagaaaauc

SEQ ID NO: 6759 - RNA, 23 nt, artificial
  Chemically synthesized
aaugggaucuaugcagaaaaucu

SEQ ID NO: 6760 - RNA, 23 nt, artificial
  Chemically synthesized
augggaucuaugcagaaaaucua

SEQ ID NO: 6761 - RNA, 23 nt, artificial
  Chemically synthesized
uagccaaugcagacuucguaaau

SEQ ID NO: 6762 - RNA, 23 nt, artificial
  Chemically synthesized
aaaaaaggaaagagauaaugauc

SEQ ID NO: 6763 - RNA, 23 nt, artificial
  Chemically synthesized
aaaaaggaaagagauaaugaucu

SEQ ID NO: 6764 - RNA, 23 nt, artificial
  Chemically synthesized
aaaaggaaagagauaaugaucua

SEQ ID NO: 6765 - RNA, 23 nt, artificial
  Chemically synthesized
aaaggaaagagauaaugaucuac

SEQ ID NO: 6766 - RNA, 23 nt, artificial
  Chemically synthesized
aaggaaagagauaaugaucuacu

SEQ ID NO: 6767 - RNA, 23 nt, artificial
  Chemically synthesized
aaccauaucuccauagccaaugc

SEQ ID NO: 6768 - RNA, 23 nt, artificial
  Chemically synthesized
agugguaguauacagcuacuacc

SEQ ID NO: 6769 - RNA, 23 nt, artificial
  Chemically synthesized
cagcuacuacccuugacaauugg

SEQ ID NO: 6770 - RNA, 23 nt, artificial
  Chemically synthesized
agcuacuacccuugacaauuggg

SEQ ID NO: 6771 - RNA, 23 nt, artificial
  Chemically synthesized
gcuacuacccuugacaauugggg

SEQ ID NO: 6772 - RNA, 23 nt, artificial
  Chemically synthesized
cuacuacccuugacaauuggggu

SEQ ID NO: 6773 - RNA, 23 nt, artificial
  Chemically synthesized
uacuacccuugacaauugggguu

SEQ ID NO: 6774 - RNA, 23 nt, artificial
  Chemically synthesized
ugaaaagaggauagauuacuaag

SEQ ID NO: 6775 - RNA, 23 nt, artificial
  Chemically synthesized
gaaaagaggauagauuacuaagu

SEQ ID NO: 6776 - RNA, 23 nt, artificial
  Chemically synthesized
aaaagaggauagauuacuaagug

SEQ ID NO: 6777 - RNA, 23 nt, artificial
  Chemically synthesized
aaagaggauagauuacuaaguga

SEQ ID NO: 6778 - RNA, 23 nt, artificial
  Chemically synthesized
aagaggauagauuacuaagugaa

SEQ ID NO: 6779 - RNA, 23 nt, artificial
  Chemically synthesized
ccagucaguggugacaacuccag

SEQ ID NO: 6780 - RNA, 23 nt, artificial
  Chemically synthesized
cagucaguggugacaacuccagg

SEQ ID NO: 6781 - RNA, 23 nt, artificial
  Chemically synthesized
agucaguggugacaacuccagga

SEQ ID NO: 6782 - RNA, 23 nt, artificial
  Chemically synthesized
gucaguggugacaacuccaggac

SEQ ID NO: 6783 - RNA, 23 nt, artificial
  Chemically synthesized
ucaguggugacaacuccaggaca

SEQ ID NO: 6784 - RNA, 23 nt, artificial
  Chemically synthesized
ccggguucuugcugcucaaacug

SEQ ID NO: 6785 - RNA, 23 nt, artificial
  Chemically synthesized
caggaacaacauaaucccaguag

SEQ ID NO: 6786 - RNA, 23 nt, artificial
  Chemically synthesized
aggaacaacauaaucccaguagu

SEQ ID NO: 6787 - RNA, 23 nt, artificial
  Chemically synthesized
ggaacaacauaaucccaguaguc

SEQ ID NO: 6788 - RNA, 23 nt, artificial
  Chemically synthesized
gaacaacauaaucccaguaguca

SEQ ID NO: 6789 - RNA, 23 nt, artificial
  Chemically synthesized
aacaacauaaucccaguagucaa

SEQ ID NO: 6790 - RNA, 23 nt, artificial
  Chemically synthesized
caggaugaauacaucugucccua

SEQ ID NO: 6791 - RNA, 23 nt, artificial
  Chemically synthesized
aggaugaauacaucugucccuac

SEQ ID NO: 6792 - RNA, 23 nt, artificial
  Chemically synthesized
ggaugaauacaucugucccuacg

SEQ ID NO: 6793 - RNA, 23 nt, artificial
  Chemically synthesized
uuggcccaauucuauaaagauug

SEQ ID NO: 6794 - RNA, 23 nt, artificial
  Chemically synthesized
uggcccaauucuauaaagauugg

SEQ ID NO: 6795 - RNA, 23 nt, artificial
  Chemically synthesized
ggcccaauucuauaaagauuggc

SEQ ID NO: 6796 - RNA, 23 nt, artificial
  Chemically synthesized
gcccaauucuauaaagauuggcu

SEQ ID NO: 6797 - RNA, 23 nt, artificial
  Chemically synthesized
cccaauucuauaaagauuggcuu

SEQ ID NO: 6798 - RNA, 23 nt, artificial
  Chemically synthesized
acuguuaguggaaaaaggacaac

SEQ ID NO: 6799 - RNA, 23 nt, artificial
  Chemically synthesized
uauauauuuucccuuuuuaggac

SEQ ID NO: 6800 - RNA, 23 nt, artificial
  Chemically synthesized
uuggaaguuuugauaggcuaaau

SEQ ID NO: 6801 - RNA, 23 nt, artificial
  Chemically synthesized
uuccaagcauuugaagaguuuag

SEQ ID NO: 6802 - RNA, 23 nt, artificial
  Chemically synthesized
uccaagcauuugaagaguuuagu

SEQ ID NO: 6803 - RNA, 23 nt, artificial
  Chemically synthesized
ccaagcauuugaagaguuuaguu

SEQ ID NO: 6804 - RNA, 23 nt, artificial
  Chemically synthesized
caagcauuugaagaguuuaguuu

SEQ ID NO: 6805 - RNA, 23 nt, artificial
  Chemically synthesized
aagcauuugaagaguuuaguuug

SEQ ID NO: 6806 - RNA, 23 nt, artificial
  Chemically synthesized
cacgugcauaacacaaccucgca

SEQ ID NO: 6807 - RNA, 23 nt, artificial
  Chemically synthesized
acgugcauaacacaaccucgcaa

SEQ ID NO: 6808 - RNA, 23 nt, artificial
  Chemically synthesized
uuaaccaaauucuggcaaguuga

SEQ ID NO: 6809 - RNA, 23 nt, artificial
  Chemically synthesized
ugaaauggcaccacaagcuuuug

SEQ ID NO: 6810 - RNA, 23 nt, artificial
  Chemically synthesized
gaaauggcaccacaagcuuuugu

SEQ ID NO: 6811 - RNA, 23 nt, artificial
  Chemically synthesized
aaauggcaccacaagcuuuuguu

SEQ ID NO: 6812 - RNA, 23 nt, artificial
  Chemically synthesized
aauggcaccacaagcuuuuguug

SEQ ID NO: 6813 - RNA, 23 nt, artificial
  Chemically synthesized
cagcaaggauaugaaagccuugc

SEQ ID NO: 6814 - RNA, 23 nt, artificial
  Chemically synthesized
agcaaggauaugaaagccuugcu

SEQ ID NO: 6815 - RNA, 23 nt, artificial
  Chemically synthesized
gcaaggauaugaaagccuugcug

SEQ ID NO: 6816 - RNA, 23 nt, artificial
  Chemically synthesized
caaggauaugaaagccuugcuga

SEQ ID NO: 6817 - RNA, 23 nt, artificial
  Chemically synthesized
aaggauaugaaagccuugcugaa

SEQ ID NO: 6818 - RNA, 23 nt, artificial
  Chemically synthesized
aaagauuggcuuuguaguaucuu

SEQ ID NO: 6819 - RNA, 23 nt, artificial
  Chemically synthesized
aacaagucgaaauccugagcuga

SEQ ID NO: 6820 - RNA, 23 nt, artificial
  Chemically synthesized
gcccagagaugagauaacacugc

SEQ ID NO: 6821 - RNA, 23 nt, artificial
  Chemically synthesized
cccagagaugagauaacacugcc

SEQ ID NO: 6822 - RNA, 23 nt, artificial
  Chemically synthesized
ccagagaugagauaacacugcca

SEQ ID NO: 6823 - RNA, 23 nt, artificial
  Chemically synthesized
cagagaugagauaacacugccau

SEQ ID NO: 6824 - RNA, 23 nt, artificial
  Chemically synthesized
agagaugagauaacacugccaug

SEQ ID NO: 6825 - RNA, 23 nt, artificial
  Chemically synthesized
ucuuggcccaauucuauaaagau

SEQ ID NO: 6826 - RNA, 23 nt, artificial
  Chemically synthesized
cuuggcccaauucuauaaagauu

SEQ ID NO: 6827 - RNA, 23 nt, artificial
  Chemically synthesized
auucaauucuguacaaaaauggg

SEQ ID NO: 6828 - RNA, 23 nt, artificial
  Chemically synthesized
uucaauucuguacaaaaauggga

SEQ ID NO: 6829 - RNA, 23 nt, artificial
  Chemically synthesized
ucaauucuguacaaaaaugggau

SEQ ID NO: 6830 - RNA, 23 nt, artificial
  Chemically synthesized
caauucuguacaaaaaugggauc

SEQ ID NO: 6831 - RNA, 23 nt, artificial
  Chemically synthesized
aauucuguacaaaaaugggaucu

SEQ ID NO: 6832 - RNA, 23 nt, artificial
  Chemically synthesized
uggaagaguaaucaacuacacac

SEQ ID NO: 6833 - RNA, 23 nt, artificial
  Chemically synthesized
ggaagaguaaucaacuacacaca

SEQ ID NO: 6834 - RNA, 23 nt, artificial
  Chemically synthesized
gaagaguaaucaacuacacacaa

SEQ ID NO: 6835 - RNA, 23 nt, artificial
  Chemically synthesized
aagaguaaucaacuacacacaaa

SEQ ID NO: 6836 - RNA, 23 nt, artificial
  Chemically synthesized
agaguaaucaacuacacacaaaa

SEQ ID NO: 6837 - RNA, 23 nt, artificial
  Chemically synthesized
uugccguaauauuucucauuuac

SEQ ID NO: 6838 - RNA, 23 nt, artificial
  Chemically synthesized
agguggaaaaaaucugggugcau

SEQ ID NO: 6839 - RNA, 23 nt, artificial
  Chemically synthesized
gguggaaaaaaucugggugcaug

SEQ ID NO: 6840 - RNA, 23 nt, artificial
  Chemically synthesized
auucuguacaaaaaugggaucua

SEQ ID NO: 6841 - RNA, 23 nt, artificial
  Chemically synthesized
uucuguacaaaaaugggaucuau

SEQ ID NO: 6842 - RNA, 23 nt, artificial
  Chemically synthesized
auagccacaguccagcaauucug

SEQ ID NO: 6843 - RNA, 23 nt, artificial
  Chemically synthesized
uagccacaguccagcaauucuga

SEQ ID NO: 6844 - RNA, 23 nt, artificial
  Chemically synthesized
agccacaguccagcaauucugaa

SEQ ID NO: 6845 - RNA, 23 nt, artificial
  Chemically synthesized
gccacaguccagcaauucugaaa

SEQ ID NO: 6846 - RNA, 23 nt, artificial
  Chemically synthesized
ccacaguccagcaauucugaaau

SEQ ID NO: 6847 - RNA, 23 nt, artificial
  Chemically synthesized
acaacauaaucccaguagucaaa

SEQ ID NO: 6848 - RNA, 23 nt, artificial
  Chemically synthesized
caacauaaucccaguagucaaaa

SEQ ID NO: 6849 - RNA, 23 nt, artificial
  Chemically synthesized
aacauaaucccaguagucaaaau

SEQ ID NO: 6850 - RNA, 23 nt, artificial
  Chemically synthesized
gcaggacaucuugagcaauucuc

SEQ ID NO: 6851 - RNA, 23 nt, artificial
  Chemically synthesized
caggacaucuugagcaauucucu

SEQ ID NO: 6852 - RNA, 23 nt, artificial
  Chemically synthesized
aggacaucuugagcaauucucug

SEQ ID NO: 6853 - RNA, 23 nt, artificial
  Chemically synthesized
ggaaaaaggacaacaguucuaca

SEQ ID NO: 6854 - RNA, 23 nt, artificial
  Chemically synthesized
gaaaaaggacaacaguucuacau

SEQ ID NO: 6855 - RNA, 23 nt, artificial
  Chemically synthesized
aaaaaggacaacaguucuacauc

SEQ ID NO: 6856 - RNA, 23 nt, artificial
  Chemically synthesized
aaaaggacaacaguucuacaucg

SEQ ID NO: 6857 - RNA, 23 nt, artificial
  Chemically synthesized
cauucaauucuguacaaaaaugg

SEQ ID NO: 6858 - RNA, 23 nt, artificial
  Chemically synthesized
gaaaugguucaucugagauuaag

SEQ ID NO: 6859 - RNA, 23 nt, artificial
  Chemically synthesized
aaaugguucaucugagauuaagc

SEQ ID NO: 6860 - RNA, 23 nt, artificial
  Chemically synthesized
aaugguucaucugagauuaagca

SEQ ID NO: 6861 - RNA, 23 nt, artificial
  Chemically synthesized
ucuccagcauuuuaaccaaauuc

SEQ ID NO: 6862 - RNA, 23 nt, artificial
  Chemically synthesized
cuccagcauuuuaaccaaauucu

SEQ ID NO: 6863 - RNA, 23 nt, artificial
  Chemically synthesized
uccagcauuuuaaccaaauucug

SEQ ID NO: 6864 - RNA, 23 nt, artificial
  Chemically synthesized
ccagcauuuuaaccaaauucugg

SEQ ID NO: 6865 - RNA, 23 nt, artificial
  Chemically synthesized
aauccuaccuuccugucuaaaaa

SEQ ID NO: 6866 - RNA, 23 nt, artificial
  Chemically synthesized
gggguuaaggagagauacuucaa

SEQ ID NO: 6867 - RNA, 23 nt, artificial
  Chemically synthesized
ggguuaaggagagauacuucaau

SEQ ID NO: 6868 - RNA, 23 nt, artificial
  Chemically synthesized
gguuaaggagagauacuucaauu

SEQ ID NO: 6869 - RNA, 23 nt, artificial
  Chemically synthesized
guuaaggagagauacuucaauuc

SEQ ID NO: 6870 - RNA, 23 nt, artificial
  Chemically synthesized
uuaaggagagauacuucaauucc

SEQ ID NO: 6871 - RNA, 23 nt, artificial
  Chemically synthesized
cauaacaggcaagagagucaaag

SEQ ID NO: 6872 - RNA, 23 nt, artificial
  Chemically synthesized
auaacaggcaagagagucaaaga

SEQ ID NO: 6873 - RNA, 23 nt, artificial
  Chemically synthesized
uaacaggcaagagagucaaagau

SEQ ID NO: 6874 - RNA, 23 nt, artificial
  Chemically synthesized
aacaggcaagagagucaaagaua

SEQ ID NO: 6875 - RNA, 23 nt, artificial
  Chemically synthesized
acaggcaagagagucaaagauaa

SEQ ID NO: 6876 - RNA, 23 nt, artificial
  Chemically synthesized
aggcucucugggugauagccaca

SEQ ID NO: 6877 - RNA, 23 nt, artificial
  Chemically synthesized
ggcucucugggugauagccacag

SEQ ID NO: 6878 - RNA, 23 nt, artificial
  Chemically synthesized
gcucucugggugauagccacagu

SEQ ID NO: 6879 - RNA, 23 nt, artificial
  Chemically synthesized
cucucugggugauagccacaguc

SEQ ID NO: 6880 - RNA, 23 nt, artificial
  Chemically synthesized
ucucugggugauagccacagucc

SEQ ID NO: 6881 - RNA, 23 nt, artificial
  Chemically synthesized
aagacaaaaaauaaggccuuuau

SEQ ID NO: 6882 - RNA, 23 nt, artificial
  Chemically synthesized
agcccagagaugagauaacacug

SEQ ID NO: 6883 - RNA, 23 nt, artificial
  Chemically synthesized
ugcugcucaaacugccaguugca

SEQ ID NO: 6884 - RNA, 23 nt, artificial
  Chemically synthesized
gcugcucaaacugccaguugcaa

SEQ ID NO: 6885 - RNA, 23 nt, artificial
  Chemically synthesized
uacuacccaaucaugaaauaauc

SEQ ID NO: 6886 - RNA, 23 nt, artificial
  Chemically synthesized
aaacugagcuuauaaaggcaucu

SEQ ID NO: 6887 - RNA, 23 nt, artificial
  Chemically synthesized
aacugagcuuauaaaggcaucua

SEQ ID NO: 6888 - RNA, 23 nt, artificial
  Chemically synthesized
acugagcuuauaaaggcaucuaa

SEQ ID NO: 6889 - RNA, 23 nt, artificial
  Chemically synthesized
cugagcuuauaaaggcaucuaaa

SEQ ID NO: 6890 - RNA, 23 nt, artificial
  Chemically synthesized
ugagcuuauaaaggcaucuaaaa

SEQ ID NO: 6891 - RNA, 23 nt, artificial
  Chemically synthesized
acagugaaccuuuggagcuuaac

SEQ ID NO: 6892 - RNA, 23 nt, artificial
  Chemically synthesized
cagugaaccuuuggagcuuaaca

SEQ ID NO: 6893 - RNA, 23 nt, artificial
  Chemically synthesized
agugaaccuuuggagcuuaacaa

SEQ ID NO: 6894 - RNA, 23 nt, artificial
  Chemically synthesized
gugaaccuuuggagcuuaacaau

SEQ ID NO: 6895 - RNA, 23 nt, artificial
  Chemically synthesized
ugaaccuuuggagcuuaacaaua

SEQ ID NO: 6896 - RNA, 19 nt, artificial
  Chemically synthesized
cccagagaauugcucaaga

SEQ ID NO: 6897 - RNA, 19 nt, artificial
  Chemically synthesized
cgugaacuuggaaauugaa

SEQ ID NO: 6898 - RNA, 19 nt, artificial
  Chemically synthesized
acgugaacuuggaaauuga

SEQ ID NO: 6899 - RNA, 19 nt, artificial
  Chemically synthesized
uggagaacugucuguccaa

SEQ ID NO: 6900 - RNA, 19 nt, artificial
  Chemically synthesized
guaaaaagcuggauaggau

SEQ ID NO: 6901 - RNA, 19 nt, artificial
  Chemically synthesized
ugaacuuggaaauugaaaa

SEQ ID NO: 6902 - RNA, 19 nt, artificial
  Chemically synthesized
guauguaaaaagcuggaua

SEQ ID NO: 6903 - RNA, 19 nt, artificial
  Chemically synthesized
gauuucgacuuguuaagaa

SEQ ID NO: 6904 - RNA, 19 nt, artificial
  Chemically synthesized
gaacuuggaaauugaaaau

SEQ ID NO: 6905 - RNA, 19 nt, artificial
  Chemically synthesized
ggauuucgacuuguuaaga

SEQ ID NO: 6906 - RNA, 19 nt, artificial
  Chemically synthesized
gcacgugaacuuggaaauu

SEQ ID NO: 6907 - RNA, 19 nt, artificial
  Chemically synthesized
ccugagaaacugacccaga

SEQ ID NO: 6908 - RNA, 19 nt, artificial
  Chemically synthesized
gaacugucuguccaaauca

SEQ ID NO: 6909 - RNA, 19 nt, artificial
  Chemically synthesized
cucaggauuucgacuuguu

SEQ ID NO: 6910 - RNA, 19 nt, artificial
  Chemically synthesized
gcucaggauuucgacuugu

SEQ ID NO: 6911 - RNA, 19 nt, artificial
  Chemically synthesized
gacuuguuaagaaaaaacu

SEQ ID NO: 6912 - RNA, 19 nt, artificial
  Chemically synthesized
ucuugagcaauucucuggg

SEQ ID NO: 6913 - RNA, 19 nt, artificial
  Chemically synthesized
uucaauuuccaaguucacg

SEQ ID NO: 6914 - RNA, 19 nt, artificial
  Chemically synthesized
ucaauuuccaaguucacgu

SEQ ID NO: 6915 - RNA, 19 nt, artificial
  Chemically synthesized
uuggacagacaguucucca

SEQ ID NO: 6916 - RNA, 19 nt, artificial
  Chemically synthesized
auccuauccagcuuuuuac

SEQ ID NO: 6917 - RNA, 19 nt, artificial
  Chemically synthesized
uuuucaauuuccaaguuca

SEQ ID NO: 6918 - RNA, 19 nt, artificial
  Chemically synthesized
uauccagcuuuuuacauac

SEQ ID NO: 6919 - RNA, 19 nt, artificial
  Chemically synthesized
uucuuaacaagucgaaauc

SEQ ID NO: 6920 - RNA, 19 nt, artificial
  Chemically synthesized
auuuucaauuuccaaguuc

SEQ ID NO: 6921 - RNA, 19 nt, artificial
  Chemically synthesized
ucuuaacaagucgaaaucc

SEQ ID NO: 6922 - RNA, 19 nt, artificial
  Chemically synthesized
aauuuccaaguucacgugc

SEQ ID NO: 6923 - RNA, 19 nt, artificial
  Chemically synthesized
ucugggucaguuucucagg

SEQ ID NO: 6924 - RNA, 19 nt, artificial
  Chemically synthesized
ugauuuggacagacaguuc

SEQ ID NO: 6925 - RNA, 19 nt, artificial
  Chemically synthesized
aacaagucgaaauccugag

SEQ ID NO: 6926 - RNA, 19 nt, artificial
  Chemically synthesized
acaagucgaaauccugagc

SEQ ID NO: 6927 - RNA, 19 nt, Artificial Sequence
  Chemically synthesized
aguuuuuucuuaacaaguc

SEQ ID NO: 6928 - RNA, 19 nt, Artificial
  Chemically synthesized
  modified_base (15)..(15): Thymidine
  modified_base (18)..(18): L-deoxycytidine
cgugaacuuggaaauugaa

SEQ ID NO: 6929 - RNA, 19 nt, Artificial
  Chemically synthesized
  modified_base (15)..(15): Thymidine
  modified_base (16)..(16): L-deoxycytidine
  modified_base (18)..(18): L-deoxycytidine
cgugaacuuggaaauugaa

SEQ ID NO: 6930 - RNA, 19 nt, Artificial
  Chemically synthesized
  modified_base (1)..(1): inverted deoxyabasic moiety covalently attached to 5' rC
  modified_base (15)..(15): Thymidine
  modified_base (18)..(18): L-deoxycytidine
cgugaacuuggaaauugaa

SEQ ID NO: 6931 - RNA, 19 nt, Artificial
  Chemically synthesized
  modified_base (1)..(1): L-deoxycytidine covalently attached to 5' terminal rC
  modified_base (15)..(15): Thymidine
  modified_base (16)..(16): L-deoxycytidine
  modified_base (18)..(18): L-deoxycytidine
cgugaacuuggaaauugaa

SEQ ID NO: 6932 - RNA, 19 nt, Artificial
  Chemically synthesized
  misc_feature (1)..(1): 5' terminal C6 amino linker covalently attached to 5' rC
  misc_feature (15)..(15): Thymidine
  misc_feature (18)..(18): L-deoxycytidine
cgugaacuuggaaauugaa

SEQ ID NO: 6933 - RNA, 19 nt, Artificial
  Chemically synthesized
  misc_feature (1)..(1): 5' terminal C6 amino linker covalently attached to 5' rC
  modified_base (15)..(15): Thymidine
  modified_base (16)..(16): L-deoxycytidine
  modified_base (18)..(18): L-deoxycytidine
cgugaacuuggaaauugaa

SEQ ID NO: 6934 - RNA, 19 nt, Artificial
  Chemically synthesized
  modified_base (2)..(2): L-deoxycytidine
  modified_base (15)..(15): Thymidine
  modified_base (18)..(18): L-deoxycytidine
cgugaacuuggaaauugaa

SEQ ID NO: 6935 - RNA, 19 nt, Artificial
  Chemically synthesized
  modified_base (2)..(2): L-deoxycytidine
  modified_base (15)..(15): Thymidine
  modified_base (16)..(16): L-deoxycytidine
  modified_base (18)..(18): L-deoxycytidine
cgugaacuuggaaauugaa

SEQ ID NO: 6936 - RNA, 19 nt, Artificial
  Chemically synthesized
  modified_base (15)..(15): deoxyadenosine
  modified_base (18)..(18): L-deoxycytidine
guaaaaagcuggauaggau

SEQ ID NO: 6937 - RNA, 19 nt, Artificial
  Chemically synthesized
  modified_base (15)..(15): Deoxyadenosine
  modified_base (17)..(17): L-deoxycytidine
  modified_base (18)..(18): L-deoxycytidine
guaaaaagcuggauaggau

SEQ ID NO: 6938 - RNA, 19 nt, Artificial
  Chemically synthesized
  modified_base (15)..(15): Deoxyguanosine
  modified_base (18)..(18): L-deoxycytidine
ugaacuuggaaauugaaaa

SEQ ID NO: 6939 - RNA, 19 nt, Artificial
  Chemically synthesized
  modified_base (15)..(15): Deoxyguanosine
  modified_base (17)..(17): L-deoxycytidine
  modified_base (18)..(18): L-deoxycytidine
ugaacuuggaaauugaaaa

SEQ ID NO: 6940 - RNA, 19 nt, Artificial
  Chemically synthesized
  modified_base (15)..(15): Deoxyguanosine
  modified_base (18)..(18): L-deoxycytidine
guauguaaaaagcuggaua

SEQ ID NO: 6941 - RNA, 19 nt, Artificial
  Chemically synthesized
  modified_base (15)..(15): Deoxyguanosine
  modified_base (17)..(17): L-deoxycytidine
  modified_base (18)..(18): L-deoxycytidine
guauguaaaaagcuggaua

SEQ ID NO: 6942 - RNA, 19 nt, Artificial
  Chemically synthesized
  modified_base (15)..(15): deoxyadenosine
  modified_base (18)..(18): L-deoxycytidine
gauuucgacuuguuaagaa

SEQ ID NO: 6943 - RNA, 19 nt, Artificial
  Chemically synthesized
  modified_base (15)..(15): Deoxyadenosine
  modified_base (17)..(17): L-deoxycytidine
  modified_base (18)..(18): L-deoxycytidine
gauuucgacuuguuaagaa

SEQ ID NO: 6944 - RNA, 19 nt, Artificial
  Chemically synthesized
  modified_base (15)..(15): deoxyadenosine
  modified_base (18)..(18): L-deoxycytidine
gaacuuggaaauugaaaau

SEQ ID NO: 6945 - RNA, 19 nt, Artificial
  Chemically synthesized
  modified_base (15)..(15): deoxyadenosine
  modified_base (17)..(17): L-deoxycytidine
  modified_base (18)..(18): L-deoxycytidine
gaacuuggaaauugaaaau

SEQ ID NO: 6946 - RNA, 19 nt, Artificial
  Chemically synthesized
  modified_base (15)..(15): Thymidine
  modified_base (18)..(18): L-deoxycytidine
ggauuucgacuuguuaaga

SEQ ID NO: 6947 - RNA, 19 nt, Artificial
  Chemically synthesized
  modified_base (15)..(15): Thymidine
  modified_base (17)..(17): L-deoxycytidine
  modified_base (18)..(18): L-deoxycytidine
ggauuucgacuuguuaaga

SEQ ID NO: 6948 - RNA, 19 nt, Artificial
  Chemically synthesized
  modified_base (15)..(15): Deoxyadenosine
  modified_base (18)..(18): L-deoxycytidine
gcacgugaacuuggaaauu

SEQ ID NO: 6949 - RNA, 19 nt, Artificial
  Chemically synthesized
  modified_base (15)..(15): deoxyadenosine
  modified_base (17)..(17): L-deoxycytidine
  modified_base (18)..(18): L-deoxycytidine
gcacgugaacuuggaaauu

SEQ ID NO: 6950 - RNA, 19 nt, Artificial
  Chemically synthesized
  modified_base (15)..(15): Deoxycytidine
  modified_base (18)..(18): L-deoxycytidine
ccugagaaacugacccaga

SEQ ID NO: 6951 - RNA, 19 nt, Artificial
  Chemically synthesized
  modified_base (15)..(15): Deoxycytidine
  modified_base (17)..(17): L-deoxycytidine
  modified_base (18)..(18): L-deoxycytidine
ccugagaaacugacccaga

SEQ ID NO: 6952 - RNA, 19 nt, Artificial
  Chemically synthesized
  modified_base (15)..(15): Deoxyadenosine
  modified_base (18)..(18): L-deoxycytidine
gaacugucuguccaaauca

SEQ ID NO: 6953 - RNA, 19 nt, Artificial
  Chemically synthesized
  modified_base (15)..(15): deoxyadenosine
  modified_base (17)..(17): L-deoxycytidine
  modified_base (18)..(18): L-deoxycytidine
gaacugucuguccaaauca

SEQ ID NO: 6954 - RNA, 19 nt, Artificial
  Chemically synthesized
  modified_base (15)..(15): Thymidine
  modified_base (18)..(18): L-deoxycytidine
cucaggauuucgacuuguu

SEQ ID NO: 6955 - RNA, 19 nt, Artificial
  Chemically synthesized
  modified_base (15)..(15): thymidine
  modified_base (17)..(17): L-deoxycytidine
  modified_base (18)..(18): L-deoxycytidine
cucaggauuucgacuuguu

SEQ ID NO: 6956 - RNA, 19 nt, Artificial
  Chemically synthesized
  modified_base (15)..(15): deoxycytidine
  modified_base (18)..(18): L-deoxycytidine
gcucaggauuucgacuugu

SEQ ID NO: 6957 - RNA, 19 nt, Artificial
  Chemically synthesized
  modified_base (15)..(15): deoxycytidine
  modified_base (17)..(17): L-deoxycytidine
  modified_base (18)..(18): L-deoxycytidine
gcucaggauuucgacuugu

SEQ ID NO: 6958 - RNA, 19 nt, Artificial
  Chemically synthesized
  modified_base (15)..(15): Deoxyadenosine
  modified_base (18)..(18): L-deoxycytidine
gacuuguuaagaaaaaacu

SEQ ID NO: 6959 - RNA, 19 nt, Artificial
  Chemically synthesized
  modified_base (15)..(15): deoxyadenosine
  modified_base (17)..(17): L-deoxycytidine
  modified_base (18)..(18): L-deoxycytidine
gacuuguuaagaaaaaacu

SEQ ID NO: 6960 - RNA, 19 nt, Artificial
  Chemically synthesized
  modified_base (15)..(15): deoxyadenosine
  modified_base (18)..(18): L-deoxycytidine
acgugaacuuggaaauuga

SEQ ID NO: 6961 - RNA, 19 nt, Artificial
  Chemically synthesized
  modified_base (15)..(15): deoxyadenosine
  modified_base (17)..(17): L-thymidine
  modified_base (18)..(18): L-deoxycytidine
acgugaacuuggaaauuga

SEQ ID NO: 6962 - RNA, 19 nt, Artificial
  Chemically synthesized
  modified_base (15)..(15): Thymidine
  modified_base (17)..(17): L-deoxycytidine
  modified_base (18)..(18): L-deoxycytidine
uggagaacugucuguccaa

SEQ ID NO: 6963 - RNA, 19 nt, Artificial
  Chemically synthesized
  modified_base (15)..(15): Thymidine
  modified_base (18)..(18): L-deoxycytidine
uggagaacugucuguccaa

SEQ ID NO: 6964 - RNA, 19 nt, Artificial
  Chemically synthesized
  modified_base (15)..(15): Deoxycytidine
  modified_base (18)..(18): L-deoxycytidine
cccagagaauugcucaaga

SEQ ID NO: 6965 - RNA, 19 nt, Artificial
  Chemically synthesized
  modified_base (15)..(15): Deoxycytidine
  modified_base (17)..(17): L-deoxycytidine
  modified_base (18)..(18): L-deoxycytidine
cccagagaauugcucaaga

SEQ ID NO: 6966 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uucaauuuccaaguucacg

SEQ ID NO: 6967 - RNA, 19 nt, Artificial
  Chemically synthesized
  modified_base (2)..(2): 2' O-methyl modified
  modified_base (4)..(4): 2' O-methyl modified
  modified_base (6)..(6): 2' O-methyl modified
  modified_base (8)..(8): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uucaauuuccaaguucacg

SEQ ID NO: 6968 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
auccuauccagcuuuuuac

SEQ ID NO: 6969 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uuuucaauuuccaaguuca

SEQ ID NO: 6970 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uauccagcuuuuuacauac

SEQ ID NO: 6971 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uucuuaacaagucgaaauc

SEQ ID NO: 6972 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
auuuucaauuuccaaguuc

SEQ ID NO: 6973 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
ucuuaacaagucgaaaucc

SEQ ID NO: 6974 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
aauuuccaaguucacgugc

SEQ ID NO: 6975 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
ucugggucaguuucucagg

SEQ ID NO: 6976 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
ugauuuggacagacaguuc

SEQ ID NO: 6977 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
aacaagucgaaauccugag

SEQ ID NO: 6978 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
acaagucgaaauccugagc

SEQ ID NO: 6979 - skipped

SEQ ID NO: 6980 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
ucaauuuccaaguucacgu

SEQ ID NO: 6981 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
uuggacagacaguucucca

SEQ ID NO: 6982 - RNA, 19 nt, Artificial
  Chemically synthesized
  modified_base (1)..(1): 2' O-methyl modified
  modified_base (3)..(3): 2' O-methyl modified
  modified_base (5)..(5): 2' O-methyl modified
  modified_base (7)..(7): 2' O-methyl modified
  modified_base (9)..(9): 2' O-methyl modified
  modified_base (11)..(11): 2' O-methyl modified
  modified_base (13)..(13): 2' O-methyl modified
  modified_base (15)..(15): 2' O-methyl modified
  modified_base (17)..(17): 2' O-methyl modified
  modified_base (19)..(19): 2' O-methyl modified
ucuugagcaauucucuggg

SEQ ID NO: 6983 - RNA, 19 nt, Artificial
  Chemically synthesized
gugccaaccugaugcagcu

SEQ ID NO: 6984 - RNA, 19 nt, Artificial
  Chemically synthesized
agcugcaucagguuggcac

What is claimed is:

1. A double-stranded RNA compound having the following structure:

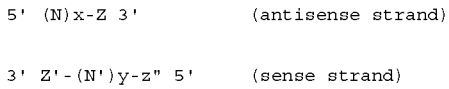

```
5'  (N)x-Z 3'           (antisense strand)

3'  Z'-(N')y-z" 5'      (sense strand)
``` wherein each of N and N' is a ribonucleotide which may be unmodified or modified, or is an unconventional moiety;

wherein each of (N)x and (N')y is an oligonucleotide in which each consecutive N or N' is joined to the next N or N' by a covalent bond;

wherein Z and Z' may be present or absent, but if present is independently 1-5 consecutive nucleotides covalently attached at the 3' terminus of the strand in which it is present;

wherein z" may be present or absent, but if present is a capping moiety covalently attached at the 5' terminus of (N')y;

wherein each of x and y is 19;

wherein (N)x comprises at least five unmodified and at least five 2'-O-methyl sugar modified ribonucleotides in an alternating pattern beginning at the 3' end and at least nine 2'-O-methyl sugar modified ribonucleotides in total and each remaining N is an unmodified ribonucleotide;

wherein (N')y comprises at least one unconventional moiety selected from the group consisting of a modified deoxyribonucleotide, an unmodified deoxyribonucleotide, a mirror nucleotide, and a nucleotide joined to an adjacent nucleotide by a 2'-5' internucleotide phosphate bond;

wherein the sequence of (N')y is 5' ACGUGAACUUG-GAAAUUGA (SEQ ID NO:6898); and wherein the sequence of (N)x is 5' UCAAUUUCCAAGUUCACGU 3' (SEQ ID NO:6914).

2. The double-stranded RNA compound of claim 1, wherein (N)x comprises 2'-O-methyl sugar modified ribonucleotides at positions 1, 3, 5, 7, 9, 11, 13, 15, 17 and 19.

3. The double-stranded RNA compound of claim 1, wherein (N)x comprises 2'-O-methyl sugar modified ribonucleotides at positions 2, 4, 6, 8, 11, 13, 15, 17, and 19.

4. The double-stranded RNA compound of claim 1, wherein (N')y comprises a mirror nucleotide.

5. The double-stranded RNA compound of claim 4, wherein the mirror nucleotide is present at position 18.

6. The double-stranded RNA compound of claim 5, wherein (N')y further comprises a mirror nucleotide at position 17.

7. The double-stranded RNA compound of claim 1 or 5, wherein (N')y comprises a deoxyribonucleotide at position 15.

8. The double-stranded RNA compound of claim 1, wherein each of (N)x and (N')y is unphosphorylated or phosphorylated at the 5' terminus and the 3' terminus.

9. The double-stranded RNA compound of claim 8, wherein (N)x is unphosphorylated at the 3' terminus.

10. The double-stranded RNA compound of claim 1, wherein z" is present.

11. The double-stranded RNA compound of claim 1 having the structure:

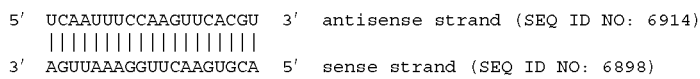

```
5'  UCAAUUUCCAAGUUCACGU  3'   antisense strand (SEQ ID NO: 6914)
    |||||||||||||||||||
3'  AGUUAAAGGUUCAAGUGCA  5'   sense strand (SEQ ID NO: 6898)
``` wherein each of A, C, U and G is an unmodified or a 2'-O-methyl sugar modified ribonucleotide or may be replaced by an unconventional moiety; and wherein in 5'-3' order each A, C, U, G or unconventional moiety is joined to the next A, C, U, G or unconventional moiety by a phosphodiester bond.

12. A composition comprising the double-stranded RNA compound of claim 1 or 11; and a pharmaceutically acceptable carrier.

13. The double-stranded RNA compound of claim 1, wherein the covalent bond joining each consecutive N or N' is a phosphodiester bond.

14. The double-stranded RNA compound of claim 11, wherein the sense strand comprises at least one unconventional moiety which is a mirror nucleotide.

15. The double-stranded RNA compound of claim 14, wherein the mirror nucleotide is L-DNA.

16. The double-stranded RNA compound of claim 15, wherein the L-DNA is present at position 18 of the sense strand.

17. The double-stranded RNA compound of claim 15, wherein the L-DNA is present at positions 17 and 18 of the sense strand.

18. The double-stranded RNA compound of claim 10, wherein z" is selected from the group consisting of an abasic ribose moiety, a deoxyribose moiety; an inverted abasic ribose moiety, a deoxyribose moiety; C6-amino-Pi; and a mirror nucleotide.

19. The double-stranded RNA compound of claim 16 or 17, wherein the L-DNA is L-deoxyribocytidine.

* * * * *